United States Patent 7,034,009 (ENZYMATIC NUCLEIC ACID-MEDIATED TREATMENT OF OCULAR DISEASES OR CONDITIONS RELATED TO LEVELS OF VASCULAR ENDOTHELIAL GROWTH FACTOR RECEPTOR (VEGF-R)) - sequence listing, part 2

SEQ ID NO: 14837 - RNA, 38 nt, Artificial Sequence
  Description of Artificial Sequence:  Enzymatic Nucleic Acid
  misc_feature (31)..(31): n stands for inosine
ucuuuguucugaugaggccguuaggccgaanugccaac

SEQ ID NO: 14838 - RNA, 38 nt, Artificial Sequence
  Description of Artificial Sequence:  Enzymatic Nucleic Acid
  misc_feature (31)..(31): n stands for inosine
ucguucuucugaugaggccguuaggccgaanuuagugc

SEQ ID NO: 14839 - RNA, 38 nt, Artificial Sequence
  Description of Artificial Sequence:  Enzymatic Nucleic Acid
  misc_feature (31)..(31): n stands for inosine
aaaggaagcugaugaggccguuaggccgaancucguuc

SEQ ID NO: 14840 - RNA, 38 nt, Artificial Sequence
  Description of Artificial Sequence:  Enzymatic Nucleic Acid
  misc_feature (31)..(31): n stands for inosine
ugaaaggacugaugaggccguuaggccgaanugcucgu

SEQ ID NO: 14841 - RNA, 38 nt, Artificial Sequence
  Description of Artificial Sequence:  Enzymatic Nucleic Acid
  misc_feature (31)..(31): n stands for inosine
cucugaaacugaugaggccguuaggccgaanaagugcu

SEQ ID NO: 14842 - RNA, 38 nt, Artificial Sequence
  Description of Artificial Sequence:  Enzymatic Nucleic Acid
  misc_feature (31)..(31): n stands for inosine
acucugaacugaugaggccguuaggccgaangaagugc

SEQ ID NO: 14843 - RNA, 38 nt, Artificial Sequence
  Description of Artificial Sequence:  Enzymatic Nucleic Acid
  misc_feature (31)..(31): n stands for inosine
agaaacuccugaugaggccguuaggccgaanaaaggaa

SEQ ID NO: 14844 - RNA, 38 nt, Artificial Sequence
  Description of Artificial Sequence:  Enzymatic Nucleic Acid
  misc_feature (31)..(31): n stands for inosine
auuaucuccugaugaggccguuaggccgaanaaacucu

SEQ ID NO: 14845 - RNA, 38 nt, Artificial Sequence
  Description of Artificial Sequence:  Enzymatic Nucleic Acid
  misc_feature (31)..(31): n stands for inosine
acccagaccugaugaggccguuaggccgaanuuccacg

SEQ ID NO: 14846 - RNA, 38 nt, Artificial Sequence
  Description of Artificial Sequence:  Enzymatic Nucleic Acid
  misc_feature (31)..(31): n stands for inosine
uuccaccccugaugaggccguuaggccgaanacuguuc

SEQ ID NO: 14847 - RNA, 38 nt, Artificial Sequence
  Description of Artificial Sequence:  Enzymatic Nucleic Acid
  misc_feature (31)..(31): n stands for inosine
augguuuccugaugaggccguuaggccgaanccccauu

SEQ ID NO: 14848 - RNA, 38 nt, Artificial Sequence
  Description of Artificial Sequence:  Enzymatic Nucleic Acid
  misc_feature (31)..(31): n stands for inosine
uugcacaucugaugaggccguuaggccgaanuuucagc

SEQ ID NO: 14849 - RNA, 38 nt, Artificial Sequence
  Description of Artificial Sequence:  Enzymatic Nucleic Acid
  misc_feature (31)..(31): n stands for inosine
cuugcacacugaugaggccguuaggccgaanguuucag

SEQ ID NO: 14850 - RNA, 38 nt, Artificial Sequence
  Description of Artificial Sequence:  Enzymatic Nucleic Acid
  misc_feature (31)..(31): n stands for inosine
cacagacucugaugaggccguuaggccgaancacaugg

SEQ ID NO: 14851 - RNA, 38 nt, Artificial Sequence
  Description of Artificial Sequence:  Enzymatic Nucleic Acid
  misc_feature (31)..(31): n stands for inosine
caagacaccugaugaggccguuaggccgaanacuugca

SEQ ID NO: 14852 - RNA, 38 nt, Artificial Sequence
  Description of Artificial Sequence:  Enzymatic Nucleic Acid
  misc_feature (31)..(31): n stands for inosine
gacugacacugaugaggccguuaggccgaanacacaga

SEQ ID NO: 14853 - RNA, 38 nt, Artificial Sequence
  Description of Artificial Sequence:  Enzymatic Nucleic Acid
  misc_feature (31)..(31): n stands for inosine
ucuuggaccugaugaggccguuaggccgaanacaagac

SEQ ID NO: 14854 - RNA, 38 nt, Artificial Sequence
  Description of Artificial Sequence:  Enzymatic Nucleic Acid
  misc_feature (31)..(31): n stands for inosine
cacuucuucugaugaggccguuaggccgaanacugaca

SEQ ID NO: 14855 - RNA, 38 nt, Artificial Sequence
  Description of Artificial Sequence:  Enzymatic Nucleic Acid
  misc_feature (31)..(31): n stands for inosine
ucacuucucugaugaggccguuaggccgaangacugac

SEQ ID NO: 14856 - RNA, 38 nt, Artificial Sequence
  Description of Artificial Sequence:  Enzymatic Nucleic Acid
  misc_feature (31)..(31): n stands for inosine
caucucggcugaugaggccguuaggccgaanucacuuc

SEQ ID NO: 14857 - RNA, 38 nt, Artificial Sequence
  Description of Artificial Sequence:  Enzymatic Nucleic Acid
  misc_feature (31)..(31): n stands for inosine
aacaucuccugaugaggccguuaggccgaanugucacu

SEQ ID NO: 14858 - RNA, 38 nt, Artificial Sequence
  Description of Artificial Sequence:  Enzymatic Nucleic Acid
  misc_feature (31)..(31): n stands for inosine
aaggcacgcugaugaggccguuaggccgaanucccuaa

SEQ ID NO: 14859 - RNA, 38 nt, Artificial Sequence
  Description of Artificial Sequence:  Enzymatic Nucleic Acid
  misc_feature (31)..(31): n stands for inosine
caaggcaccugaugaggccguuaggccgaangucccua

SEQ ID NO: 14860 - RNA, 38 nt, Artificial Sequence
  Description of Artificial Sequence:  Enzymatic Nucleic Acid
  misc_feature (31)..(31): n stands for inosine
ggaaacaacugaugaggccguuaggccgaancacgggu

SEQ ID NO: 14861 - RNA, 38 nt, Artificial Sequence
  Description of Artificial Sequence:  Enzymatic Nucleic Acid
  misc_feature (31)..(31): n stands for inosine
aggaaacacugaugaggccguuaggccgaangcacggg

SEQ ID NO: 14862 - RNA, 38 nt, Artificial Sequence
  Description of Artificial Sequence:  Enzymatic Nucleic Acid
  misc_feature (31)..(31): n stands for inosine
gugggcuacugaugaggccguuaggccgaanaaacaag

SEQ ID NO: 14863 - RNA, 38 nt, Artificial Sequence
  Description of Artificial Sequence:  Enzymatic Nucleic Acid
  misc_feature (31)..(31): n stands for inosine
ugugggcucugaugaggccguuaggccgaangaaacaa

SEQ ID NO: 14864 - RNA, 38 nt, Artificial Sequence
  Description of Artificial Sequence:  Enzymatic Nucleic Acid
  misc_feature (31)..(31): n stands for inosine
uucuugugcugaugaggccguuaggccgaancuaggaa

SEQ ID NO: 14865 - RNA, 38 nt, Artificial Sequence
  Description of Artificial Sequence:  Enzymatic Nucleic Acid
  misc_feature (31)..(31): n stands for inosine
auucuugucugaugaggccguuaggccgaangcuagga

SEQ ID NO: 14866 - RNA, 38 nt, Artificial Sequence
  Description of Artificial Sequence:  Enzymatic Nucleic Acid
  misc_feature (31)..(31): n stands for inosine
cauucuugcugaugaggccguuaggccgaanggcuagg

SEQ ID NO: 14867 - RNA, 38 nt, Artificial Sequence
  Description of Artificial Sequence:  Enzymatic Nucleic Acid
  misc_feature (31)..(31): n stands for inosine
ugcauucucugaugaggccguuaggccgaanugggcua

SEQ ID NO: 14868 - RNA, 38 nt, Artificial Sequence
  Description of Artificial Sequence:  Enzymatic Nucleic Acid
  misc_feature (31)..(31): n stands for inosine
uugauguucugaugaggccguuaggccgaancauucuu

SEQ ID NO: 14869 - RNA, 38 nt, Artificial Sequence
  Description of Artificial Sequence:  Enzymatic Nucleic Acid
  misc_feature (31)..(31): n stands for inosine
cuguuugacugaugaggccguuaggccgaanuuugcau

SEQ ID NO: 14870 - RNA, 38 nt, Artificial Sequence
  Description of Artificial Sequence:  Enzymatic Nucleic Acid
  misc_feature (31)..(31): n stands for inosine
uaucuguucugaugaggccguuaggccgaanauguuug

SEQ ID NO: 14871 - RNA, 38 nt, Artificial Sequence
  Description of Artificial Sequence:  Enzymatic Nucleic Acid
  misc_feature (31)..(31): n stands for inosine
cgaguauccugaugaggccguuaggccgaanuuugaug

SEQ ID NO: 14872 - RNA, 38 nt, Artificial Sequence
  Description of Artificial Sequence:  Enzymatic Nucleic Acid
  misc_feature (31)..(31): n stands for inosine
ggcuagcgcugaugaggccguuaggccgaanuaucugu

SEQ ID NO: 14873 - RNA, 38 nt, Artificial Sequence
  Description of Artificial Sequence:  Enzymatic Nucleic Acid
  misc_feature (31)..(31): n stands for inosine
augaggcucugaugaggccguuaggccgaancgaguau

SEQ ID NO: 14874 - RNA, 38 nt, Artificial Sequence
  Description of Artificial Sequence:  Enzymatic Nucleic Acid
  misc_feature (31)..(31): n stands for inosine
uuaaaugacugaugaggccguuaggccgaancuagcga

SEQ ID NO: 14875 - RNA, 38 nt, Artificial Sequence
  Description of Artificial Sequence:  Enzymatic Nucleic Acid
  misc_feature (31)..(31): n stands for inosine
uuuaaaugcugaugaggccguuaggccgaangcuagcg

SEQ ID NO: 14876 - RNA, 38 nt, Artificial Sequence
  Description of Artificial Sequence:  Enzymatic Nucleic Acid
  misc_feature (31)..(31): n stands for inosine
aauuuaaacugaugaggccguuaggccgaanaggcuag

SEQ ID NO: 14877 - RNA, 38 nt, Artificial Sequence
  Description of Artificial Sequence:  Enzymatic Nucleic Acid
  misc_feature (31)..(31): n stands for inosine
gccaaagacugaugaggccguuaggccgaancacuccu

SEQ ID NO: 14878 - RNA, 38 nt, Artificial Sequence
  Description of Artificial Sequence:  Enzymatic Nucleic Acid
  misc_feature (31)..(31): n stands for inosine
ucggccaacugaugaggccguuaggccgaanaugcacu

SEQ ID NO: 14879 - RNA, 38 nt, Artificial Sequence
  Description of Artificial Sequence:  Enzymatic Nucleic Acid
  misc_feature (31)..(31): n stands for inosine
ccacuguccugaugaggccguuaggccgaanccaaaga

SEQ ID NO: 14880 - RNA, 38 nt, Artificial Sequence
  Description of Artificial Sequence:  Enzymatic Nucleic Acid
  misc_feature (31)..(31): n stands for inosine
uacaccaccugaugaggccguuaggccgaanucggcca

SEQ ID NO: 14881 - RNA, 38 nt, Artificial Sequence
  Description of Artificial Sequence:  Enzymatic Nucleic Acid
  misc_feature (31)..(31): n stands for inosine
acacacaccugaugaggccguuaggccgaanuuacacc

SEQ ID NO: 14882 - RNA, 38 nt, Artificial Sequence
  Description of Artificial Sequence:  Enzymatic Nucleic Acid
  misc_feature (31)..(31): n stands for inosine
aauaguuacugaugaggccguuaggccgaancacaaaa

SEQ ID NO: 14883 - RNA, 38 nt, Artificial Sequence
  Description of Artificial Sequence:  Enzymatic Nucleic Acid
  misc_feature (31)..(31): n stands for inosine
ccuuaaaucugaugaggccguuaggccgaanuuaugca

SEQ ID NO: 14884 - RNA, 38 nt, Artificial Sequence
  Description of Artificial Sequence:  Enzymatic Nucleic Acid
  misc_feature (31)..(31): n stands for inosine
aaaauucccugaugaggccguuaggccgaanuuuccuu

SEQ ID NO: 14885 - RNA, 38 nt, Artificial Sequence
  Description of Artificial Sequence:  Enzymatic Nucleic Acid
  misc_feature (31)..(31): n stands for inosine
uguauaaacugaugaggccguuaggccgaanuaacuuu

SEQ ID NO: 14886 - RNA, 38 nt, Artificial Sequence
  Description of Artificial Sequence:  Enzymatic Nucleic Acid
  misc_feature (31)..(31): n stands for inosine
ucuugguucugaugaggccguuaggccgaanuauaaaa

SEQ ID NO: 14887 - RNA, 38 nt, Artificial Sequence
  Description of Artificial Sequence:  Enzymatic Nucleic Acid
  misc_feature (31)..(31): n stands for inosine
auauucuucugaugaggccguuaggccgaanuuuguau

SEQ ID NO: 14888 - RNA, 38 nt, Artificial Sequence
  Description of Artificial Sequence:  Enzymatic Nucleic Acid
  misc_feature (31)..(31): n stands for inosine
uauauucucugaugaggccguuaggccgaanguuugua

SEQ ID NO: 14889 - RNA, 38 nt, Artificial Sequence
  Description of Artificial Sequence:  Enzymatic Nucleic Acid
  misc_feature (31)..(31): n stands for inosine
auaucugucugaugaggccguuaggccgaancauauau

SEQ ID NO: 14890 - RNA, 38 nt, Artificial Sequence
  Description of Artificial Sequence:  Enzymatic Nucleic Acid
  misc_feature (31)..(31): n stands for inosine
cuuauauccugaugaggccguuaggccgaanuagcaua

SEQ ID NO: 14891 - RNA, 38 nt, Artificial Sequence
  Description of Artificial Sequence:  Enzymatic Nucleic Acid
  misc_feature (31)..(31): n stands for inosine
accauguccugaugaggccguuaggccgaanucuuaua

SEQ ID NO: 14892 - RNA, 38 nt, Artificial Sequence
  Description of Artificial Sequence:  Enzymatic Nucleic Acid
  misc_feature (31)..(31): n stands for inosine
ccaaaccacugaugaggccguuaggccgaanucugucu

SEQ ID NO: 14893 - RNA, 38 nt, Artificial Sequence
  Description of Artificial Sequence:  Enzymatic Nucleic Acid
  misc_feature (31)..(31): n stands for inosine
gaaauauacugaugaggccguuaggccgaanaccaaac

SEQ ID NO: 14894 - RNA, 38 nt, Artificial Sequence
  Description of Artificial Sequence:  Enzymatic Nucleic Acid
  misc_feature (31)..(31): n stands for inosine
agaaauaucugaugaggccguuaggccgaangaccaaa

SEQ ID NO: 14895 - RNA, 38 nt, Artificial Sequence
  Description of Artificial Sequence:  Enzymatic Nucleic Acid
  misc_feature (31)..(31): n stands for inosine
ucaugacucugaugaggccguuaggccgaanaaauaua

SEQ ID NO: 14896 - RNA, 38 nt, Artificial Sequence
  Description of Artificial Sequence:  Enzymatic Nucleic Acid
  misc_feature (31)..(31): n stands for inosine
auucaucacugaugaggccguuaggccgaanacuagaa

SEQ ID NO: 14897 - RNA, 38 nt, Artificial Sequence
  Description of Artificial Sequence:  Enzymatic Nucleic Acid
  misc_feature (31)..(31): n stands for inosine
augaagaucugaugaggccguuaggccgaanuauacaa

SEQ ID NO: 14898 - RNA, 38 nt, Artificial Sequence
  Description of Artificial Sequence:  Enzymatic Nucleic Acid
  misc_feature (31)..(31): n stands for inosine
uaugaagacugaugaggccguuaggccgaanguauaca

SEQ ID NO: 14899 - RNA, 38 nt, Artificial Sequence
  Description of Artificial Sequence:  Enzymatic Nucleic Acid
  misc_feature (31)..(31): n stands for inosine
uuauaugacugaugaggccguuaggccgaanaugguau

SEQ ID NO: 14900 - RNA, 38 nt, Artificial Sequence
  Description of Artificial Sequence:  Enzymatic Nucleic Acid
  misc_feature (31)..(31): n stands for inosine
auauuauacugaugaggccguuaggccgaanaagaugg

SEQ ID NO: 14901 - RNA, 38 nt, Artificial Sequence
  Description of Artificial Sequence:  Enzymatic Nucleic Acid
  misc_feature (31)..(31): n stands for inosine
uauuuuuacugaugaggccguuaggccgaanuauauua

SEQ ID NO: 14902 - RNA, 38 nt, Artificial Sequence
  Description of Artificial Sequence:  Enzymatic Nucleic Acid
  misc_feature (31)..(31): n stands for inosine
cccaauuacugaugaggccguuaggccgaanaaauauu

SEQ ID NO: 14903 - RNA, 38 nt, Artificial Sequence
  Description of Artificial Sequence:  Enzymatic Nucleic Acid
  misc_feature (31)..(31): n stands for inosine
auuaaguucugaugaggccguuaggccgaanuacgauu

SEQ ID NO: 14904 - RNA, 38 nt, Artificial Sequence
  Description of Artificial Sequence:  Enzymatic Nucleic Acid
  misc_feature (31)..(31): n stands for inosine
aauuaagucugaugaggccguuaggccgaanguacgau

SEQ ID NO: 14905 - RNA, 38 nt, Artificial Sequence
  Description of Artificial Sequence:  Enzymatic Nucleic Acid
  misc_feature (31)..(31): n stands for inosine
aucaauuacugaugaggccguuaggccgaanuugguac

SEQ ID NO: 14906 - RNA, 38 nt, Artificial Sequence
  Description of Artificial Sequence:  Enzymatic Nucleic Acid
  misc_feature (31)..(31): n stands for inosine
aguugccacugaugaggccguuaggccgaanuuuauca

SEQ ID NO: 14907 - RNA, 38 nt, Artificial Sequence
  Description of Artificial Sequence:  Enzymatic Nucleic Acid
  misc_feature (31)..(31): n stands for inosine
aaagcagucugaugaggccguuaggccgaanccaaguu

SEQ ID NO: 14908 - RNA, 38 nt, Artificial Sequence
  Description of Artificial Sequence:  Enzymatic Nucleic Acid
  misc_feature (31)..(31): n stands for inosine
auaaaagccugaugaggccguuaggccgaanuugccaa

SEQ ID NO: 14909 - RNA, 38 nt, Artificial Sequence
  Description of Artificial Sequence:  Enzymatic Nucleic Acid
  misc_feature (31)..(31): n stands for inosine
aacauaaacugaugaggccguuaggccgaancaguugc

SEQ ID NO: 14910 - RNA, 38 nt, Artificial Sequence
  Description of Artificial Sequence:  Enzymatic Nucleic Acid
  misc_feature (31)..(31): n stands for inosine
aaggagaccugaugaggccguuaggccgaanaacauaa

SEQ ID NO: 14911 - RNA, 38 nt, Artificial Sequence
  Description of Artificial Sequence:  Enzymatic Nucleic Acid
  misc_feature (31)..(31): n stands for inosine
auggaaggcugaugaggccguuaggccgaanacagaac

SEQ ID NO: 14912 - RNA, 38 nt, Artificial Sequence
  Description of Artificial Sequence:  Enzymatic Nucleic Acid
  misc_feature (31)..(31): n stands for inosine
uuauggaacugaugaggccguuaggccgaanagacaga

SEQ ID NO: 14913 - RNA, 38 nt, Artificial Sequence
  Description of Artificial Sequence:  Enzymatic Nucleic Acid
  misc_feature (31)..(31): n stands for inosine
uuuauggacugaugaggccguuaggccgaangagacag

SEQ ID NO: 14914 - RNA, 38 nt, Artificial Sequence
  Description of Artificial Sequence:  Enzymatic Nucleic Acid
  misc_feature (31)..(31): n stands for inosine
aaauuuaucugaugaggccguuaggccgaanaaggaga

SEQ ID NO: 14915 - RNA, 38 nt, Artificial Sequence
  Description of Artificial Sequence:  Enzymatic Nucleic Acid
  misc_feature (31)..(31): n stands for inosine
aaaauuuacugaugaggccguuaggccgaangaaggag

SEQ ID NO: 14916 - RNA, 38 nt, Artificial Sequence
  Description of Artificial Sequence:  Enzymatic Nucleic Acid
  misc_feature (31)..(31): n stands for inosine
uaguauuucugaugaggccguuaggccgaanaaaaauu

SEQ ID NO: 14917 - RNA, 38 nt, Artificial Sequence
  Description of Artificial Sequence:  Enzymatic Nucleic Acid
  misc_feature (31)..(31): n stands for inosine
guugaauucugaugaggccguuaggccgaanuauuuug

SEQ ID NO: 14918 - RNA, 38 nt, Artificial Sequence
  Description of Artificial Sequence:  Enzymatic Nucleic Acid
  misc_feature (31)..(31): n stands for inosine
uucuuugucugaugaggccguuaggccgaanaauuagu

SEQ ID NO: 14919 - RNA, 38 nt, Artificial Sequence
  Description of Artificial Sequence:  Enzymatic Nucleic Acid
  misc_feature (31)..(31): n stands for inosine
uuuuucuucugaugaggccguuaggccgaanuugaauu

SEQ ID NO: 14920 - RNA, 38 nt, Artificial Sequence
  Description of Artificial Sequence:  Enzymatic Nucleic Acid
  misc_feature (31)..(31): n stands for inosine
aaaaaaagcugaugaggccguuaggccgaancuuuuuc

SEQ ID NO: 14921 - RNA, 38 nt, Artificial Sequence
  Description of Artificial Sequence:  Enzymatic Nucleic Acid
  misc_feature (31)..(31): n stands for inosine
gaaaaaaacugaugaggccguuaggccgaanagcuuuu

SEQ ID NO: 14922 - RNA, 38 nt, Artificial Sequence
  Description of Artificial Sequence:  Enzymatic Nucleic Acid
  misc_feature (31)..(31): n stands for inosine
uuauuuuacugaugaggccguuaggccgaanaaaaaaa

SEQ ID NO: 14923 - RNA, 38 nt, Artificial Sequence
  Description of Artificial Sequence:  Enzymatic Nucleic Acid
  misc_feature (31)..(31): n stands for inosine
uuuauuuucugaugaggccguuaggccgaangaaaaaa

SEQ ID NO: 14924 - RNA, 38 nt, Artificial Sequence
  Description of Artificial Sequence:  Enzymatic Nucleic Acid
  misc_feature (31)..(31): n stands for inosine
uaaauuugcugaugaggccguuaggccgaanuuuauuu

SEQ ID NO: 14925 - RNA, 38 nt, Artificial Sequence
  Description of Artificial Sequence:  Enzymatic Nucleic Acid
  misc_feature (31)..(31): n stands for inosine
gauaaauucugaugaggccguuaggccgaanaguuuau

SEQ ID NO: 14926 - RNA, 38 nt, Artificial Sequence
  Description of Artificial Sequence:  Enzymatic Nucleic Acid
  misc_feature (31)..(31): n stands for inosine
cuaaacaacugaugaggccguuaggccgaanauaaauu

SEQ ID NO: 14927 - RNA, 38 nt, Artificial Sequence
  Description of Artificial Sequence:  Enzymatic Nucleic Acid
  misc_feature (31)..(31): n stands for inosine
ucuaaacacugaugaggccguuaggccgaangauaaau

SEQ ID NO: 14928 - RNA, 38 nt, Artificial Sequence
  Description of Artificial Sequence:  Enzymatic Nucleic Acid
  misc_feature (31)..(31): n stands for inosine
uuuuucuccugaugaggccguuaggccgaancucuaaa

SEQ ID NO: 14929 - RNA, 38 nt, Artificial Sequence
  Description of Artificial Sequence:  Enzymatic Nucleic Acid
  misc_feature (31)..(31): n stands for inosine
cauuucaacugaugaggccguuaggccgaanuuuuucu

SEQ ID NO: 14930 - RNA, 38 nt, Artificial Sequence
  Description of Artificial Sequence:  Enzymatic Nucleic Acid
  misc_feature (31)..(31): n stands for inosine
auuuuuugcugaugaggccguuaggccgaanaccauuu

SEQ ID NO: 14931 - RNA, 38 nt, Artificial Sequence
  Description of Artificial Sequence:  Enzymatic Nucleic Acid
  misc_feature (31)..(31): n stands for inosine
caauuuuucugaugaggccguuaggccgaanagaccau

SEQ ID NO: 14932 - RNA, 38 nt, Artificial Sequence
  Description of Artificial Sequence:  Enzymatic Nucleic Acid
  misc_feature (31)..(31): n stands for inosine
aaauauuucugaugaggccguuaggccgaancaauuuu

SEQ ID NO: 14933 - RNA, 38 nt, Artificial Sequence
  Description of Artificial Sequence:  Enzymatic Nucleic Acid
  misc_feature (31)..(31): n stands for inosine
uuuuccaucugaugaggccguuaggccgaanaaaauau

SEQ ID NO: 14934 - RNA, 38 nt, Artificial Sequence
  Description of Artificial Sequence:  Enzymatic Nucleic Acid
  misc_feature (31)..(31): n stands for inosine
uaacauuucugaugaggccguuaggccgaanuuuucca

SEQ ID NO: 14935 - RNA, 38 nt, Artificial Sequence
  Description of Artificial Sequence:  Enzymatic Nucleic Acid
  misc_feature (31)..(31): n stands for inosine
auacaauccugaugaggccguuaggccgaancuaaacu

SEQ ID NO: 14936 - RNA, 38 nt, Artificial Sequence
  Description of Artificial Sequence:  Enzymatic Nucleic Acid
  misc_feature (31)..(31): n stands for inosine
aagugaaacugaugaggccguuaggccgaanuucgaaa

SEQ ID NO: 14937 - RNA, 38 nt, Artificial Sequence
  Description of Artificial Sequence:  Enzymatic Nucleic Acid
  misc_feature (31)..(31): n stands for inosine
aaagugaacugaugaggccguuaggccgaanguucgaa

SEQ ID NO: 14938 - RNA, 38 nt, Artificial Sequence
  Description of Artificial Sequence:  Enzymatic Nucleic Acid
  misc_feature (31)..(31): n stands for inosine
acaaaaagcugaugaggccguuaggccgaanaaagguu

SEQ ID NO: 14939 - RNA, 38 nt, Artificial Sequence
  Description of Artificial Sequence:  Enzymatic Nucleic Acid
  misc_feature (31)..(31): n stands for inosine
aaacaaaacugaugaggccguuaggccgaanugaaagg

SEQ ID NO: 14940 - RNA, 38 nt, Artificial Sequence
  Description of Artificial Sequence:  Enzymatic Nucleic Acid
  misc_feature (31)..(31): n stands for inosine
gugaaauacugaugaggccguuaggccgaanuaaaaca

SEQ ID NO: 14941 - RNA, 38 nt, Artificial Sequence
  Description of Artificial Sequence:  Enzymatic Nucleic Acid
  misc_feature (31)..(31): n stands for inosine
ugugaaaucugaugaggccguuaggccgaanguaaaac

SEQ ID NO: 14942 - RNA, 38 nt, Artificial Sequence
  Description of Artificial Sequence:  Enzymatic Nucleic Acid
  misc_feature (31)..(31): n stands for inosine
cacaguugcugaugaggccguuaggccgaanaaauagg

SEQ ID NO: 14943 - RNA, 38 nt, Artificial Sequence
  Description of Artificial Sequence:  Enzymatic Nucleic Acid
  misc_feature (31)..(31): n stands for inosine
uacacagucugaugaggccguuaggccgaanugaaaua

SEQ ID NO: 14944 - RNA, 38 nt, Artificial Sequence
  Description of Artificial Sequence:  Enzymatic Nucleic Acid
  misc_feature (31)..(31): n stands for inosine
auuuacaccugaugaggccguuaggccgaanuugugaa

SEQ ID NO: 14945 - RNA, 38 nt, Artificial Sequence
  Description of Artificial Sequence:  Enzymatic Nucleic Acid
  misc_feature (31)..(31): n stands for inosine
gaauuauucugaugaggccguuaggccgaancaauuua

SEQ ID NO: 14946 - RNA, 38 nt, Artificial Sequence
  Description of Artificial Sequence:  Enzymatic Nucleic Acid
  misc_feature (31)..(31): n stands for inosine
ggaauuaucugaugaggccguuaggccgaangcaauuu

SEQ ID NO: 14947 - RNA, 38 nt, Artificial Sequence
  Description of Artificial Sequence:  Enzymatic Nucleic Acid
  misc_feature (31)..(31): n stands for inosine
cauggacacugaugaggccguuaggccgaanaauuauu

SEQ ID NO: 14948 - RNA, 38 nt, Artificial Sequence
  Description of Artificial Sequence:  Enzymatic Nucleic Acid
  misc_feature (31)..(31): n stands for inosine
ucauggaccugaugaggccguuaggccgaangaauuau

SEQ ID NO: 14949 - RNA, 38 nt, Artificial Sequence
  Description of Artificial Sequence:  Enzymatic Nucleic Acid
  misc_feature (31)..(31): n stands for inosine
auuuucaucugaugaggccguuaggccgaanacaggaa

SEQ ID NO: 14950 - RNA, 38 nt, Artificial Sequence
  Description of Artificial Sequence:  Enzymatic Nucleic Acid
  misc_feature (31)..(31): n stands for inosine
cauuuucacugaugaggccguuaggccgaangacagga

SEQ ID NO: 14951 - RNA, 38 nt, Artificial Sequence
  Description of Artificial Sequence:  Enzymatic Nucleic Acid
  misc_feature (31)..(31): n stands for inosine
ggauaauucugaugaggccguuaggccgaancauuuuc

SEQ ID NO: 14952 - RNA, 38 nt, Artificial Sequence
  Description of Artificial Sequence:  Enzymatic Nucleic Acid
  misc_feature (31)..(31): n stands for inosine
ucuacacucugaugaggccguuaggccgaanauaauuu

SEQ ID NO: 14953 - RNA, 38 nt, Artificial Sequence
  Description of Artificial Sequence:  Enzymatic Nucleic Acid
  misc_feature (31)..(31): n stands for inosine
aucuacaccugaugaggccguuaggccgaangauaauu

SEQ ID NO: 14954 - RNA, 38 nt, Artificial Sequence
  Description of Artificial Sequence:  Enzymatic Nucleic Acid
  misc_feature (31)..(31): n stands for inosine
agggugaucugaugaggccguuaggccgaanucaaaua

SEQ ID NO: 14955 - RNA, 38 nt, Artificial Sequence
  Description of Artificial Sequence:  Enzymatic Nucleic Acid
  misc_feature (31)..(31): n stands for inosine
uagggugacugaugaggccguuaggccgaangucaaau

SEQ ID NO: 14956 - RNA, 38 nt, Artificial Sequence
  Description of Artificial Sequence:  Enzymatic Nucleic Acid
  misc_feature (31)..(31): n stands for inosine
ccauagggcugaugaggccguuaggccgaanaugguca

SEQ ID NO: 14957 - RNA, 38 nt, Artificial Sequence
  Description of Artificial Sequence:  Enzymatic Nucleic Acid
  misc_feature (31)..(31): n stands for inosine
auccauagcugaugaggccguuaggccgaanugauggu

SEQ ID NO: 14958 - RNA, 38 nt, Artificial Sequence
  Description of Artificial Sequence:  Enzymatic Nucleic Acid
  misc_feature (31)..(31): n stands for inosine
uauccauacugaugaggccguuaggccgaangugaugg

SEQ ID NO: 14959 - RNA, 38 nt, Artificial Sequence
  Description of Artificial Sequence:  Enzymatic Nucleic Acid
  misc_feature (31)..(31): n stands for inosine
auauccaucugaugaggccguuaggccgaanggugaug

SEQ ID NO: 14960 - RNA, 38 nt, Artificial Sequence
  Description of Artificial Sequence:  Enzymatic Nucleic Acid
  misc_feature (31)..(31): n stands for inosine
gcaaaacucugaugaggccguuaggccgaanccaauau

SEQ ID NO: 14961 - RNA, 38 nt, Artificial Sequence
  Description of Artificial Sequence:  Enzymatic Nucleic Acid
  misc_feature (31)..(31): n stands for inosine
uuaauaaacugaugaggccguuaggccgaancaaaacu

SEQ ID NO: 14962 - RNA, 38 nt, Artificial Sequence
  Description of Artificial Sequence:  Enzymatic Nucleic Acid
  misc_feature (31)..(31): n stands for inosine
cuuaauaacugaugaggccguuaggccgaangcaaaac

SEQ ID NO: 14963 - RNA, 38 nt, Artificial Sequence
  Description of Artificial Sequence:  Enzymatic Nucleic Acid
  misc_feature (31)..(31): n stands for inosine
aaugaauucugaugaggccguuaggccgaancuuaaua

SEQ ID NO: 14964 - RNA, 38 nt, Artificial Sequence
  Description of Artificial Sequence:  Enzymatic Nucleic Acid
  misc_feature (31)..(31): n stands for inosine
ggcugaaacugaugaggccguuaggccgaanaauuugc

SEQ ID NO: 14965 - RNA, 38 nt, Artificial Sequence
  Description of Artificial Sequence:  Enzymatic Nucleic Acid
  misc_feature (31)..(31): n stands for inosine
auucaggccugaugaggccguuaggccgaanaaaugaa

SEQ ID NO: 14966 - RNA, 38 nt, Artificial Sequence
  Description of Artificial Sequence:  Enzymatic Nucleic Acid
  misc_feature (31)..(31): n stands for inosine
gacauucacugaugaggccguuaggccgaancugaaau

SEQ ID NO: 14967 - RNA, 38 nt, Artificial Sequence
  Description of Artificial Sequence:  Enzymatic Nucleic Acid
  misc_feature (31)..(31): n stands for inosine
agacauuccugaugaggccguuaggccgaangcugaaa

SEQ ID NO: 14968 - RNA, 38 nt, Artificial Sequence
  Description of Artificial Sequence:  Enzymatic Nucleic Acid
  misc_feature (31)..(31): n stands for inosine
auauaggccugaugaggccguuaggccgaanacauuca

SEQ ID NO: 14969 - RNA, 38 nt, Artificial Sequence
  Description of Artificial Sequence:  Enzymatic Nucleic Acid
  misc_feature (31)..(31): n stands for inosine
aauauauacugaugaggccguuaggccgaancagacau

SEQ ID NO: 14970 - RNA, 38 nt, Artificial Sequence
  Description of Artificial Sequence:  Enzymatic Nucleic Acid
  misc_feature (31)..(31): n stands for inosine
gaauauaucugaugaggccguuaggccgaangcagaca

SEQ ID NO: 14971 - RNA, 38 nt, Artificial Sequence
  Description of Artificial Sequence:  Enzymatic Nucleic Acid
  misc_feature (31)..(31): n stands for inosine
aagagcagcugaugaggccguuaggccgaanaauauau

SEQ ID NO: 14972 - RNA, 38 nt, Artificial Sequence
  Description of Artificial Sequence:  Enzymatic Nucleic Acid
  misc_feature (31)..(31): n stands for inosine
caaagagccugaugaggccguuaggccgaanagaauau

SEQ ID NO: 14973 - RNA, 38 nt, Artificial Sequence
  Description of Artificial Sequence:  Enzymatic Nucleic Acid
  misc_feature (31)..(31): n stands for inosine
auacaaagcugaugaggccguuaggccgaancagagaa

SEQ ID NO: 14974 - RNA, 38 nt, Artificial Sequence
  Description of Artificial Sequence:  Enzymatic Nucleic Acid
  misc_feature (31)..(31): n stands for inosine
gaauacaacugaugaggccguuaggccgaanagcagag

SEQ ID NO: 14975 - RNA, 38 nt, Artificial Sequence
  Description of Artificial Sequence:  Enzymatic Nucleic Acid
  misc_feature (31)..(31): n stands for inosine
uucaaaggcugaugaggccguuaggccgaanaauacaa

SEQ ID NO: 14976 - RNA, 38 nt, Artificial Sequence
  Description of Artificial Sequence:  Enzymatic Nucleic Acid
  misc_feature (31)..(31): n stands for inosine
gguucaaacugaugaggccguuaggccgaanagaauac

SEQ ID NO: 14977 - RNA, 38 nt, Artificial Sequence
  Description of Artificial Sequence:  Enzymatic Nucleic Acid
  misc_feature (31)..(31): n stands for inosine
ggguucaacugaugaggccguuaggccgaangagaaua

SEQ ID NO: 14978 - RNA, 38 nt, Artificial Sequence
  Description of Artificial Sequence:  Enzymatic Nucleic Acid
  misc_feature (31)..(31): n stands for inosine
uuuuaacgcugaugaggccguuaggccgaanuucaaag

SEQ ID NO: 14979 - RNA, 38 nt, Artificial Sequence
  Description of Artificial Sequence:  Enzymatic Nucleic Acid
  misc_feature (31)..(31): n stands for inosine
guuuuaaccugaugaggccguuaggccgaanguucaaa

SEQ ID NO: 14980 - RNA, 38 nt, Artificial Sequence
  Description of Artificial Sequence:  Enzymatic Nucleic Acid
  misc_feature (31)..(31): n stands for inosine
ccacaggacugaugaggccguuaggccgaanuuuuaac

SEQ ID NO: 14981 - RNA, 38 nt, Artificial Sequence
  Description of Artificial Sequence:  Enzymatic Nucleic Acid
  misc_feature (31)..(31): n stands for inosine
gugccacacugaugaggccguuaggccgaanauguuuu

SEQ ID NO: 14982 - RNA, 38 nt, Artificial Sequence
  Description of Artificial Sequence:  Enzymatic Nucleic Acid
  misc_feature (31)..(31): n stands for inosine
agugccaccugaugaggccguuaggccgaangauguuu

SEQ ID NO: 14983 - RNA, 36 nt, Artificial Sequence
  Description of Artificial Sequence:  Enzymatic Nucleic Acid
cgcugugauggcaugcacuaugcgcgacccgagccc

SEQ ID NO: 14984 - RNA, 36 nt, Artificial Sequence
  Description of Artificial Sequence:  Enzymatic Nucleic Acid
auccuugauggcaugcacuaugcgcggccgccaggc

SEQ ID NO: 14985 - RNA, 36 nt, Artificial Sequence
  Description of Artificial Sequence:  Enzymatic Nucleic Acid
ggagaugauggcaugcacuaugcgcgaaccacuucc

SEQ ID NO: 14986 - RNA, 36 nt, Artificial Sequence
  Description of Artificial Sequence:  Enzymatic Nucleic Acid
ucucgugauggcaugcacuaugcgcgggcuccagcc

SEQ ID NO: 14987 - RNA, 36 nt, Artificial Sequence
  Description of Artificial Sequence:  Enzymatic Nucleic Acid
cgucuugauggcaugcacuaugcgcggcggcuccag

SEQ ID NO: 14988 - RNA, 36 nt, Artificial Sequence
  Description of Artificial Sequence:  Enzymatic Nucleic Acid
cugagugauggcaugcacuaugcgcggcccgucucg

SEQ ID NO: 14989 - RNA, 36 nt, Artificial Sequence
  Description of Artificial Sequence:  Enzymatic Nucleic Acid
ccccgugauggcaugcacuaugcgcggcccugagcg

SEQ ID NO: 14990 - RNA, 36 nt, Artificial Sequence
  Description of Artificial Sequence:  Enzymatic Nucleic Acid
ucguuugauggcaugcacuaugcgcggccgccgccg

SEQ ID NO: 14991 - RNA, 36 nt, Artificial Sequence
  Description of Artificial Sequence:  Enzymatic Nucleic Acid
ccucuugauggcaugcacuaugcgcgguucgccgcc

SEQ ID NO: 14992 - RNA, 36 nt, Artificial Sequence
  Description of Artificial Sequence:  Enzymatic Nucleic Acid
gcccgugauggcaugcacuaugcgcggcucccccgg

SEQ ID NO: 14993 - RNA, 36 nt, Artificial Sequence
  Description of Artificial Sequence:  Enzymatic Nucleic Acid
cugcuugauggcaugcacuaugcgcggcccggugcc

SEQ ID NO: 14994 - RNA, 36 nt, Artificial Sequence
  Description of Artificial Sequence:  Enzymatic Nucleic Acid
cgacgugauggcaugcacuaugcgcgggccugcucg

SEQ ID NO: 14995 - RNA, 36 nt, Artificial Sequence
  Description of Artificial Sequence:  Enzymatic Nucleic Acid
gagcgugauggcaugcacuaugcgcggacgcggccu

SEQ ID NO: 14996 - RNA, 36 nt, Artificial Sequence
  Description of Artificial Sequence:  Enzymatic Nucleic Acid
gugagugauggcaugcacuaugcgcggcgacgcggc

SEQ ID NO: 14997 - RNA, 36 nt, Artificial Sequence
  Description of Artificial Sequence:  Enzymatic Nucleic Acid
cacagugauggcaugcacuaugcgcgaggaccccgg

SEQ ID NO: 14998 - RNA, 36 nt, Artificial Sequence
  Description of Artificial Sequence:  Enzymatic Nucleic Acid
gcgcaugauggcaugcacuaugcgcgagcaggaccc

SEQ ID NO: 14999 - RNA, 36 nt, Artificial Sequence
  Description of Artificial Sequence:  Enzymatic Nucleic Acid
gcgcgugauggcaugcacuaugcgcgacagcaggac

SEQ ID NO: 15000 - RNA, 36 nt, Artificial Sequence
  Description of Artificial Sequence:  Enzymatic Nucleic Acid
cagcgugauggcaugcacuaugcgcggcacagcagg

SEQ ID NO: 15001 - RNA, 36 nt, Artificial Sequence
  Description of Artificial Sequence:  Enzymatic Nucleic Acid
agcagugauggcaugcacuaugcgcggcgcacagca

SEQ ID NO: 15002 - RNA, 36 nt, Artificial Sequence
  Description of Artificial Sequence:  Enzymatic Nucleic Acid
cugagugauggcaugcacuaugcgcgagcgcgcaca

SEQ ID NO: 15003 - RNA, 36 nt, Artificial Sequence
  Description of Artificial Sequence:  Enzymatic Nucleic Acid
gcagaugauggcaugcacuaugcgcgagcugagcag

SEQ ID NO: 15004 - RNA, 36 nt, Artificial Sequence
  Description of Artificial Sequence:  Enzymatic Nucleic Acid
agaagugauggcaugcacuaugcgcgagacagcuga

SEQ ID NO: 15005 - RNA, 36 nt, Artificial Sequence
  Description of Artificial Sequence:  Enzymatic Nucleic Acid
caguuugauggcaugcacuaugcgcgaggaucuuuu

SEQ ID NO: 15006 - RNA, 36 nt, Artificial Sequence
  Description of Artificial Sequence:  Enzymatic Nucleic Acid
aaacuugauggcaugcacuaugcgcgaguucaggau

SEQ ID NO: 15007 - RNA, 36 nt, Artificial Sequence
  Description of Artificial Sequence:  Enzymatic Nucleic Acid
gcuugugauggcaugcacuaugcgcgaugaugugcu

SEQ ID NO: 15008 - RNA, 36 nt, Artificial Sequence
  Description of Artificial Sequence:  Enzymatic Nucleic Acid
agaugugauggcaugcacuaugcgcgagugucuggc

SEQ ID NO: 15009 - RNA, 36 nt, Artificial Sequence
  Description of Artificial Sequence:  Enzymatic Nucleic Acid
cccugugauggcaugcacuaugcgcgauuggagaug

SEQ ID NO: 15010 - RNA, 36 nt, Artificial Sequence
  Description of Artificial Sequence:  Enzymatic Nucleic Acid
ucaggugauggcaugcacuaugcgcgaaagaccauu

SEQ ID NO: 15011 - RNA, 36 nt, Artificial Sequence
  Description of Artificial Sequence:  Enzymatic Nucleic Acid
cauuuugauggcaugcacuaugcgcgaggcaaagac

SEQ ID NO: 15012 - RNA, 36 nt, Artificial Sequence
  Description of Artificial Sequence:  Enzymatic Nucleic Acid
uuacuugauggcaugcacuaugcgcgaccauuucag

SEQ ID NO: 15013 - RNA, 36 nt, Artificial Sequence
  Description of Artificial Sequence:  Enzymatic Nucleic Acid
ccuuuugauggcaugcacuaugcgcggcuuuccuua

SEQ ID NO: 15014 - RNA, 36 nt, Artificial Sequence
  Description of Artificial Sequence:  Enzymatic Nucleic Acid
augcuugauggcaugcacuaugcgcgagccuuucgc

SEQ ID NO: 15015 - RNA, 36 nt, Artificial Sequence
  Description of Artificial Sequence:  Enzymatic Nucleic Acid
acaggugauggcaugcacuaugcgcgagauuuaguu

SEQ ID NO: 15016 - RNA, 36 nt, Artificial Sequence
  Description of Artificial Sequence:  Enzymatic Nucleic Acid
uuccaugauggcaugcacuaugcgcgaggcagauuu

SEQ ID NO: 15017 - RNA, 36 nt, Artificial Sequence
  Description of Artificial Sequence:  Enzymatic Nucleic Acid
uacugugauggcaugcacuaugcgcgagaauuguuu

SEQ ID NO: 15018 - RNA, 36 nt, Artificial Sequence
  Description of Artificial Sequence:  Enzymatic Nucleic Acid
guguuugauggcaugcacuaugcgcgaagguuaaag

SEQ ID NO: 15019 - RNA, 36 nt, Artificial Sequence
  Description of Artificial Sequence:  Enzymatic Nucleic Acid
auuugugauggcaugcacuaugcgcgagcuguagaa

SEQ ID NO: 15020 - RNA, 36 nt, Artificial Sequence
  Description of Artificial Sequence:  Enzymatic Nucleic Acid
agguaugauggcaugcacuaugcgcgagcuagauau

SEQ ID NO: 15021 - RNA, 36 nt, Artificial Sequence
  Description of Artificial Sequence:  Enzymatic Nucleic Acid
gauugugauggcaugcacuaugcgcgagauucuguu

SEQ ID NO: 15022 - RNA, 36 nt, Artificial Sequence
  Description of Artificial Sequence:  Enzymatic Nucleic Acid
uguauugauggcaugcacuaugcgcgacuaauaaau

SEQ ID NO: 15023 - RNA, 36 nt, Artificial Sequence
  Description of Artificial Sequence:  Enzymatic Nucleic Acid
cuguaugauggcaugcacuaugcgcgaucucuacga

SEQ ID NO: 15024 - RNA, 36 nt, Artificial Sequence
  Description of Artificial Sequence:  Enzymatic Nucleic Acid
gauuuugauggcaugcacuaugcgcgacuguacauc

SEQ ID NO: 15025 - RNA, 36 nt, Artificial Sequence
  Description of Artificial Sequence:  Enzymatic Nucleic Acid
aauuuugauggcaugcacuaugcgcgggggauuuca

SEQ ID NO: 15026 - RNA, 36 nt, Artificial Sequence
  Description of Artificial Sequence:  Enzymatic Nucleic Acid
ucaguugauggcaugcacuaugcgcgauguguauaa

SEQ ID NO: 15027 - RNA, 36 nt, Artificial Sequence
  Description of Artificial Sequence:  Enzymatic Nucleic Acid
uccuuugauggcaugcacuaugcgcgagucaugugu

SEQ ID NO: 15028 - RNA, 36 nt, Artificial Sequence
  Description of Artificial Sequence:  Enzymatic Nucleic Acid
cccggugauggcaugcacuaugcgcgagggaaugac

SEQ ID NO: 15029 - RNA, 36 nt, Artificial Sequence
  Description of Artificial Sequence:  Enzymatic Nucleic Acid
aguaaugauggcaugcacuaugcgcgagugauguua

SEQ ID NO: 15030 - RNA, 36 nt, Artificial Sequence
  Description of Artificial Sequence:  Enzymatic Nucleic Acid
aguguugauggcaugcacuaugcgcgaaguggaaac

SEQ ID NO: 15031 - RNA, 36 nt, Artificial Sequence
  Description of Artificial Sequence:  Enzymatic Nucleic Acid
gggauugauggcaugcacuaugcgcgaaagugucaa

SEQ ID NO: 15032 - RNA, 36 nt, Artificial Sequence
  Description of Artificial Sequence:  Enzymatic Nucleic Acid
uccauugauggcaugcacuaugcgcgagggaucaaa

SEQ ID NO: 15033 - RNA, 36 nt, Artificial Sequence
  Description of Artificial Sequence:  Enzymatic Nucleic Acid
uuaugugauggcaugcacuaugcgcgguuuuccauc

SEQ ID NO: 15034 - RNA, 36 nt, Artificial Sequence
  Description of Artificial Sequence:  Enzymatic Nucleic Acid
cguugugauggcaugcacuaugcgcgauuugauaug

SEQ ID NO: 15035 - RNA, 36 nt, Artificial Sequence
  Description of Artificial Sequence:  Enzymatic Nucleic Acid
cagguugauggcaugcacuaugcgcgagaagcccua

SEQ ID NO: 15036 - RNA, 36 nt, Artificial Sequence
  Description of Artificial Sequence:  Enzymatic Nucleic Acid
cuucaugauggcaugcacuaugcgcgaggucagaag

SEQ ID NO: 15037 - RNA, 36 nt, Artificial Sequence
  Description of Artificial Sequence:  Enzymatic Nucleic Acid
ugcuuugauggcaugcacuaugcgcgacaggucaga

SEQ ID NO: 15038 - RNA, 36 nt, Artificial Sequence
  Description of Artificial Sequence:  Enzymatic Nucleic Acid
uuauaugauggcaugcacuaugcgcgaaaugcccau

SEQ ID NO: 15039 - RNA, 36 nt, Artificial Sequence
  Description of Artificial Sequence:  Enzymatic Nucleic Acid
uuuguugauggcaugcacuaugcgcggaugugugag

SEQ ID NO: 15040 - RNA, 36 nt, Artificial Sequence
  Description of Artificial Sequence:  Enzymatic Nucleic Acid
uuggaugauggcaugcacuaugcgcgaucuaugauu

SEQ ID NO: 15041 - RNA, 36 nt, Artificial Sequence
  Description of Artificial Sequence:  Enzymatic Nucleic Acid
cugggugauggcaugcacuaugcgcgguggugugcu

SEQ ID NO: 15042 - RNA, 36 nt, Artificial Sequence
  Description of Artificial Sequence:  Enzymatic Nucleic Acid
gaggaugauggcaugcacuaugcgcgaagaguaugg

SEQ ID NO: 15043 - RNA, 36 nt, Artificial Sequence
  Description of Artificial Sequence:  Enzymatic Nucleic Acid
caguaugauggcaugcacuaugcgcgaauugaggac

SEQ ID NO: 15044 - RNA, 36 nt, Artificial Sequence
  Description of Artificial Sequence:  Enzymatic Nucleic Acid
gguagugauggcaugcacuaugcgcgaguacaauug

SEQ ID NO: 15045 - RNA, 36 nt, Artificial Sequence
  Description of Artificial Sequence:  Enzymatic Nucleic Acid
guguuugauggcaugcacuaugcgcgaagggagugg

SEQ ID NO: 15046 - RNA, 36 nt, Artificial Sequence
  Description of Artificial Sequence:  Enzymatic Nucleic Acid
acucuugauggcaugcacuaugcgcgguguucaagg

SEQ ID NO: 15047 - RNA, 36 nt, Artificial Sequence
  Description of Artificial Sequence:  Enzymatic Nucleic Acid
cagguugauggcaugcacuaugcgcgauuugaacuc

SEQ ID NO: 15048 - RNA, 36 nt, Artificial Sequence
  Description of Artificial Sequence:  Enzymatic Nucleic Acid
uucauugauggcaugcacuaugcgcgaggguaacuc

SEQ ID NO: 15049 - RNA, 36 nt, Artificial Sequence
  Description of Artificial Sequence:  Enzymatic Nucleic Acid
uuuuuugauggcaugcacuaugcgcgaucaggguaa

SEQ ID NO: 15050 - RNA, 36 nt, Artificial Sequence
  Description of Artificial Sequence:  Enzymatic Nucleic Acid
uucguugauggcaugcacuaugcgcggccuuacgga

SEQ ID NO: 15051 - RNA, 36 nt, Artificial Sequence
  Description of Artificial Sequence:  Enzymatic Nucleic Acid
caauuugauggcaugcacuaugcgcggucgccuuac

SEQ ID NO: 15052 - RNA, 36 nt, Artificial Sequence
  Description of Artificial Sequence:  Enzymatic Nucleic Acid
uugguugauggcaugcacuaugcgcgaauucgucgc

SEQ ID NO: 15053 - RNA, 36 nt, Artificial Sequence
  Description of Artificial Sequence:  Enzymatic Nucleic Acid
guuggugauggcaugcacuaugcgcgaugggaauug

SEQ ID NO: 15054 - RNA, 36 nt, Artificial Sequence
  Description of Artificial Sequence:  Enzymatic Nucleic Acid
aagaaugauggcaugcacuaugcgcgacuguagaau

SEQ ID NO: 15055 - RNA, 36 nt, Artificial Sequence
  Description of Artificial Sequence:  Enzymatic Nucleic Acid
uuuguugauggcaugcacuaugcgcgaauaguaaga

SEQ ID NO: 15056 - RNA, 36 nt, Artificial Sequence
  Description of Artificial Sequence:  Enzymatic Nucleic Acid
uucugugauggcaugcacuaugcgcgauuuugucaa

SEQ ID NO: 15057 - RNA, 36 nt, Artificial Sequence
  Description of Artificial Sequence:  Enzymatic Nucleic Acid
cacgaugauggcaugcacuaugcgcgaaguauaaag

SEQ ID NO: 15058 - RNA, 36 nt, Artificial Sequence
  Description of Artificial Sequence:  Enzymatic Nucleic Acid
ccuuaugauggcaugcacuaugcgcgacgacaagua

SEQ ID NO: 15059 - RNA, 36 nt, Artificial Sequence
  Description of Artificial Sequence:  Enzymatic Nucleic Acid
guuaaugauggcaugcacuaugcgcgagauuugaau

SEQ ID NO: 15060 - RNA, 36 nt, Artificial Sequence
  Description of Artificial Sequence:  Enzymatic Nucleic Acid
auaugugauggcaugcacuaugcgcgacugaggugu

SEQ ID NO: 15061 - RNA, 36 nt, Artificial Sequence
  Description of Artificial Sequence:  Enzymatic Nucleic Acid
uuuauugauggcaugcacuaugcgcgauauauaugc

SEQ ID NO: 15062 - RNA, 36 nt, Artificial Sequence
  Description of Artificial Sequence:  Enzymatic Nucleic Acid
uuucaugauggcaugcacuaugcgcgagugaugaau

SEQ ID NO: 15063 - RNA, 36 nt, Artificial Sequence
  Description of Artificial Sequence:  Enzymatic Nucleic Acid
uguuuugauggcaugcacuaugcgcgacagugauga

SEQ ID NO: 15064 - RNA, 36 nt, Artificial Sequence
  Description of Artificial Sequence:  Enzymatic Nucleic Acid
guuuuugauggcaugcacuaugcgcggauguuucac

SEQ ID NO: 15065 - RNA, 36 nt, Artificial Sequence
  Description of Artificial Sequence:  Enzymatic Nucleic Acid
ucaagugauggcaugcacuaugcgcgaccugcuguu

SEQ ID NO: 15066 - RNA, 36 nt, Artificial Sequence
  Description of Artificial Sequence:  Enzymatic Nucleic Acid
gguuuugauggcaugcacuaugcgcgaagcaccugc

SEQ ID NO: 15067 - RNA, 36 nt, Artificial Sequence
  Description of Artificial Sequence:  Enzymatic Nucleic Acid
acuuuugauggcaugcacuaugcgcgauagagagcc

SEQ ID NO: 15068 - RNA, 36 nt, Artificial Sequence
  Description of Artificial Sequence:  Enzymatic Nucleic Acid
gccuuugauggcaugcacuaugcgcgacuuucauag

SEQ ID NO: 15069 - RNA, 36 nt, Artificial Sequence
  Description of Artificial Sequence:  Enzymatic Nucleic Acid
uccggugauggcaugcacuaugcgcggagggaaaug

SEQ ID NO: 15070 - RNA, 36 nt, Artificial Sequence
  Description of Artificial Sequence:  Enzymatic Nucleic Acid
ccauaugauggcaugcacuaugcgcgaacuuccggc

SEQ ID NO: 15071 - RNA, 36 nt, Artificial Sequence
  Description of Artificial Sequence:  Enzymatic Nucleic Acid
agucgugauggcaugcacuaugcgcgagguaaccca

SEQ ID NO: 15072 - RNA, 36 nt, Artificial Sequence
  Description of Artificial Sequence:  Enzymatic Nucleic Acid
ucaguugauggcaugcacuaugcgcggcagguaacc

SEQ ID NO: 15073 - RNA, 36 nt, Artificial Sequence
  Description of Artificial Sequence:  Enzymatic Nucleic Acid
uuucuugauggcaugcacuaugcgcgagucgcaggu

SEQ ID NO: 15074 - RNA, 36 nt, Artificial Sequence
  Description of Artificial Sequence:  Enzymatic Nucleic Acid
gcgagugauggcaugcacuaugcgcgagauuucuca

SEQ ID NO: 15075 - RNA, 36 nt, Artificial Sequence
  Description of Artificial Sequence:  Enzymatic Nucleic Acid
aauagugauggcaugcacuaugcgcggagcagauuu

SEQ ID NO: 15076 - RNA, 36 nt, Artificial Sequence
  Description of Artificial Sequence:  Enzymatic Nucleic Acid
cgaguugauggcaugcacuaugcgcgaaauagcgag

SEQ ID NO: 15077 - RNA, 36 nt, Artificial Sequence
  Description of Artificial Sequence:  Enzymatic Nucleic Acid
cucuuugauggcaugcacuaugcgcgaguuacgucc

SEQ ID NO: 15078 - RNA, 36 nt, Artificial Sequence
  Description of Artificial Sequence:  Enzymatic Nucleic Acid
cccugugauggcaugcacuaugcgcgauccucuuca

SEQ ID NO: 15079 - RNA, 36 nt, Artificial Sequence
  Description of Artificial Sequence:  Enzymatic Nucleic Acid
cucagugauggcaugcacuaugcgcgaagauuguau

SEQ ID NO: 15080 - RNA, 36 nt, Artificial Sequence
  Description of Artificial Sequence:  Enzymatic Nucleic Acid
augcuugauggcaugcacuaugcgcgagcaagauug

SEQ ID NO: 15081 - RNA, 36 nt, Artificial Sequence
  Description of Artificial Sequence:  Enzymatic Nucleic Acid
aaacaugauggcaugcacuaugcgcgauuugacugu

SEQ ID NO: 15082 - RNA, 36 nt, Artificial Sequence
  Description of Artificial Sequence:  Enzymatic Nucleic Acid
uuaaaugauggcaugcacuaugcgcgacauuugacu

SEQ ID NO: 15083 - RNA, 36 nt, Artificial Sequence
  Description of Artificial Sequence:  Enzymatic Nucleic Acid
aguggugauggcaugcacuaugcgcgagugagguuu

SEQ ID NO: 15084 - RNA, 36 nt, Artificial Sequence
  Description of Artificial Sequence:  Enzymatic Nucleic Acid
auugaugauggcaugcacuaugcgcgaauuagagug

SEQ ID NO: 15085 - RNA, 36 nt, Artificial Sequence
  Description of Artificial Sequence:  Enzymatic Nucleic Acid
uuucaugauggcaugcacuaugcgcgauugacaauu

SEQ ID NO: 15086 - RNA, 36 nt, Artificial Sequence
  Description of Artificial Sequence:  Enzymatic Nucleic Acid
gguuuugauggcaugcacuaugcgcgacauugacaa

SEQ ID NO: 15087 - RNA, 36 nt, Artificial Sequence
  Description of Artificial Sequence:  Enzymatic Nucleic Acid
cuuuuugauggcaugcacuaugcgcgguaaaucugg

SEQ ID NO: 15088 - RNA, 36 nt, Artificial Sequence
  Description of Artificial Sequence:  Enzymatic Nucleic Acid
gaugaugauggcaugcacuaugcgcgacggccuuuu

SEQ ID NO: 15089 - RNA, 36 nt, Artificial Sequence
  Description of Artificial Sequence:  Enzymatic Nucleic Acid
caaguugauggcaugcacuaugcgcgaggauuuguc

SEQ ID NO: 15090 - RNA, 36 nt, Artificial Sequence
  Description of Artificial Sequence:  Enzymatic Nucleic Acid
cgguaugauggcaugcacuaugcgcgaagucaggau

SEQ ID NO: 15091 - RNA, 36 nt, Artificial Sequence
  Description of Artificial Sequence:  Enzymatic Nucleic Acid
auaugugauggcaugcacuaugcgcggguacaaguc

SEQ ID NO: 15092 - RNA, 36 nt, Artificial Sequence
  Description of Artificial Sequence:  Enzymatic Nucleic Acid
gguuaugauggcaugcacuaugcgcgaggggugcca

SEQ ID NO: 15093 - RNA, 36 nt, Artificial Sequence
  Description of Artificial Sequence:  Enzymatic Nucleic Acid
ugcuuugauggcaugcacuaugcgcgggaaugauua

SEQ ID NO: 15094 - RNA, 36 nt, Artificial Sequence
  Description of Artificial Sequence:  Enzymatic Nucleic Acid
agucaugauggcaugcacuaugcgcgaccuugcuuc

SEQ ID NO: 15095 - RNA, 36 nt, Artificial Sequence
  Description of Artificial Sequence:  Enzymatic Nucleic Acid
aaaguugauggcaugcacuaugcgcgacaccuugcu

SEQ ID NO: 15096 - RNA, 36 nt, Artificial Sequence
  Description of Artificial Sequence:  Enzymatic Nucleic Acid
uggaaugauggcaugcacuaugcgcgaaaagucaca

SEQ ID NO: 15097 - RNA, 36 nt, Artificial Sequence
  Description of Artificial Sequence:  Enzymatic Nucleic Acid
cucuuugauggcaugcacuaugcgcgauuauuggaa

SEQ ID NO: 15098 - RNA, 36 nt, Artificial Sequence
  Description of Artificial Sequence:  Enzymatic Nucleic Acid
gucagugauggcaugcacuaugcgcgauccaggaua

SEQ ID NO: 15099 - RNA, 36 nt, Artificial Sequence
  Description of Artificial Sequence:  Enzymatic Nucleic Acid
gcuguugauggcaugcacuaugcgcgagcauccagg

SEQ ID NO: 15100 - RNA, 36 nt, Artificial Sequence
  Description of Artificial Sequence:  Enzymatic Nucleic Acid
gcucuugauggcaugcacuaugcgcgaauucuguuu

SEQ ID NO: 15101 - RNA, 36 nt, Artificial Sequence
  Description of Artificial Sequence:  Enzymatic Nucleic Acid
ccaugugauggcaugcacuaugcgcggcugagugau

SEQ ID NO: 15102 - RNA, 36 nt, Artificial Sequence
  Description of Artificial Sequence:  Enzymatic Nucleic Acid
agccaugauggcaugcacuaugcgcgaaccaaggug

SEQ ID NO: 15103 - RNA, 36 nt, Artificial Sequence
  Description of Artificial Sequence:  Enzymatic Nucleic Acid
agaguugauggcaugcacuaugcgcgagccacaacc

SEQ ID NO: 15104 - RNA, 36 nt, Artificial Sequence
  Description of Artificial Sequence:  Enzymatic Nucleic Acid
cuaugugauggcaugcacuaugcgcgaaauguagau

SEQ ID NO: 15105 - RNA, 36 nt, Artificial Sequence
  Description of Artificial Sequence:  Enzymatic Nucleic Acid
ucccaugauggcaugcacuaugcgcgagucccaacu

SEQ ID NO: 15106 - RNA, 36 nt, Artificial Sequence
  Description of Artificial Sequence:  Enzymatic Nucleic Acid
uggcaugauggcaugcacuaugcgcgaucugugaua

SEQ ID NO: 15107 - RNA, 36 nt, Artificial Sequence
  Description of Artificial Sequence:  Enzymatic Nucleic Acid
uuuggugauggcaugcacuaugcgcgacaucuguga

SEQ ID NO: 15108 - RNA, 36 nt, Artificial Sequence
  Description of Artificial Sequence:  Enzymatic Nucleic Acid
guuaaugauggcaugcacuaugcgcgaugaaaccca

SEQ ID NO: 15109 - RNA, 36 nt, Artificial Sequence
  Description of Artificial Sequence:  Enzymatic Nucleic Acid
gucggugauggcaugcacuaugcgcgauuuuuucca

SEQ ID NO: 15110 - RNA, 36 nt, Artificial Sequence
  Description of Artificial Sequence:  Enzymatic Nucleic Acid
uccguugauggcaugcacuaugcgcgggcauuuuuu

SEQ ID NO: 15111 - RNA, 36 nt, Artificial Sequence
  Description of Artificial Sequence:  Enzymatic Nucleic Acid
aguuuugauggcaugcacuaugcgcgagguccucuc

SEQ ID NO: 15112 - RNA, 36 nt, Artificial Sequence
  Description of Artificial Sequence:  Enzymatic Nucleic Acid
caagaugauggcaugcacuaugcgcgaguuucaggu

SEQ ID NO: 15113 - RNA, 36 nt, Artificial Sequence
  Description of Artificial Sequence:  Enzymatic Nucleic Acid
cugugugauggcaugcacuaugcgcgaagacaguuu

SEQ ID NO: 15114 - RNA, 36 nt, Artificial Sequence
  Description of Artificial Sequence:  Enzymatic Nucleic Acid
guccgugauggcaugcacuaugcgcgaguaaaaucc

SEQ ID NO: 15115 - RNA, 36 nt, Artificial Sequence
  Description of Artificial Sequence:  Enzymatic Nucleic Acid
uagugugauggcaugcacuaugcgcgauuguucugu

SEQ ID NO: 15116 - RNA, 36 nt, Artificial Sequence
  Description of Artificial Sequence:  Enzymatic Nucleic Acid
acauuugauggcaugcacuaugcgcgaugaugguaa

SEQ ID NO: 15117 - RNA, 36 nt, Artificial Sequence
  Description of Artificial Sequence:  Enzymatic Nucleic Acid
ggaaaugauggcaugcacuaugcgcgauucaugaug

SEQ ID NO: 15118 - RNA, 36 nt, Artificial Sequence
  Description of Artificial Sequence:  Enzymatic Nucleic Acid
ucuugugauggcaugcacuaugcgcgagggaaacau

SEQ ID NO: 15119 - RNA, 36 nt, Artificial Sequence
  Description of Artificial Sequence:  Enzymatic Nucleic Acid
gcaggugauggcaugcacuaugcgcgauaggugccu

SEQ ID NO: 15120 - RNA, 36 nt, Artificial Sequence
  Description of Artificial Sequence:  Enzymatic Nucleic Acid
cucugugauggcaugcacuaugcgcgaggcauaggu

SEQ ID NO: 15121 - RNA, 36 nt, Artificial Sequence
  Description of Artificial Sequence:  Enzymatic Nucleic Acid
guauaugauggcaugcacuaugcgcgauuccuggcu

SEQ ID NO: 15122 - RNA, 36 nt, Artificial Sequence
  Description of Artificial Sequence:  Enzymatic Nucleic Acid
uuucgugauggcaugcacuaugcgcgaggagguaug

SEQ ID NO: 15123 - RNA, 36 nt, Artificial Sequence
  Description of Artificial Sequence:  Enzymatic Nucleic Acid
gguuuugauggcaugcacuaugcgcggcaggaggua

SEQ ID NO: 15124 - RNA, 36 nt, Artificial Sequence
  Description of Artificial Sequence:  Enzymatic Nucleic Acid
gugauugauggcaugcacuaugcgcgacugagguuu

SEQ ID NO: 15125 - RNA, 36 nt, Artificial Sequence
  Description of Artificial Sequence:  Enzymatic Nucleic Acid
caugaugauggcaugcacuaugcgcgagucuaaagu

SEQ ID NO: 15126 - RNA, 36 nt, Artificial Sequence
  Description of Artificial Sequence:  Enzymatic Nucleic Acid
auuagugauggcaugcacuaugcgcgaugacagucu

SEQ ID NO: 15127 - RNA, 36 nt, Artificial Sequence
  Description of Artificial Sequence:  Enzymatic Nucleic Acid
ggggaugauggcaugcacuaugcgcgaccauuagca

SEQ ID NO: 15128 - RNA, 36 nt, Artificial Sequence
  Description of Artificial Sequence:  Enzymatic Nucleic Acid
aggcuugauggcaugcacuaugcgcgggggacacca

SEQ ID NO: 15129 - RNA, 36 nt, Artificial Sequence
  Description of Artificial Sequence:  Enzymatic Nucleic Acid
aacagugauggcaugcacuaugcgcggugcugcuuc

SEQ ID NO: 15130 - RNA, 36 nt, Artificial Sequence
  Description of Artificial Sequence:  Enzymatic Nucleic Acid
auaaaugauggcaugcacuaugcgcgagcgugcugc

SEQ ID NO: 15131 - RNA, 36 nt, Artificial Sequence
  Description of Artificial Sequence:  Enzymatic Nucleic Acid
ucuuuugauggcaugcacuaugcgcgaauaaacagc

SEQ ID NO: 15132 - RNA, 36 nt, Artificial Sequence
  Description of Artificial Sequence:  Enzymatic Nucleic Acid
accuuugauggcaugcacuaugcgcgauccucuucu

SEQ ID NO: 15133 - RNA, 36 nt, Artificial Sequence
  Description of Artificial Sequence:  Enzymatic Nucleic Acid
auagaugauggcaugcacuaugcgcgaccuucaucc

SEQ ID NO: 15134 - RNA, 36 nt, Artificial Sequence
  Description of Artificial Sequence:  Enzymatic Nucleic Acid
cuuugugauggcaugcacuaugcgcgagugauagac

SEQ ID NO: 15135 - RNA, 36 nt, Artificial Sequence
  Description of Artificial Sequence:  Enzymatic Nucleic Acid
uuccaugauggcaugcacuaugcgcgagagcccuuc

SEQ ID NO: 15136 - RNA, 36 nt, Artificial Sequence
  Description of Artificial Sequence:  Enzymatic Nucleic Acid
uugaaugauggcaugcacuaugcgcgagugagguau

SEQ ID NO: 15137 - RNA, 36 nt, Artificial Sequence
  Description of Artificial Sequence:  Enzymatic Nucleic Acid
gugauugauggcaugcacuaugcgcgagcuccagau

SEQ ID NO: 15138 - RNA, 36 nt, Artificial Sequence
  Description of Artificial Sequence:  Enzymatic Nucleic Acid
aggugugauggcaugcacuaugcgcgauguuagagu

SEQ ID NO: 15139 - RNA, 36 nt, Artificial Sequence
  Description of Artificial Sequence:  Enzymatic Nucleic Acid
ccacaugauggcaugcacuaugcgcgaggugcaugu

SEQ ID NO: 15140 - RNA, 36 nt, Artificial Sequence
  Description of Artificial Sequence:  Enzymatic Nucleic Acid
agccaugauggcaugcacuaugcgcgacaggugcau

SEQ ID NO: 15141 - RNA, 36 nt, Artificial Sequence
  Description of Artificial Sequence:  Enzymatic Nucleic Acid
agucgugauggcaugcacuaugcgcgagccacacag

SEQ ID NO: 15142 - RNA, 36 nt, Artificial Sequence
  Description of Artificial Sequence:  Enzymatic Nucleic Acid
agaguugauggcaugcacuaugcgcggcagccacac

SEQ ID NO: 15143 - RNA, 36 nt, Artificial Sequence
  Description of Artificial Sequence:  Enzymatic Nucleic Acid
uuuuuugauggcaugcacuaugcgcgggauaaggag

SEQ ID NO: 15144 - RNA, 36 nt, Artificial Sequence
  Description of Artificial Sequence:  Enzymatic Nucleic Acid
cuuuuugauggcaugcacuaugcgcgauuuuucgga

SEQ ID NO: 15145 - RNA, 36 nt, Artificial Sequence
  Description of Artificial Sequence:  Enzymatic Nucleic Acid
uauuuugauggcaugcacuaugcgcgagaagaagac

SEQ ID NO: 15146 - RNA, 36 nt, Artificial Sequence
  Description of Artificial Sequence:  Enzymatic Nucleic Acid
guaguugauggcaugcacuaugcgcgagucuuuauu

SEQ ID NO: 15147 - RNA, 36 nt, Artificial Sequence
  Description of Artificial Sequence:  Enzymatic Nucleic Acid
aacuuugauggcaugcacuaugcgcgaucugggucc

SEQ ID NO: 15148 - RNA, 36 nt, Artificial Sequence
  Description of Artificial Sequence:  Enzymatic Nucleic Acid
cugcuugauggcaugcacuaugcgcgauccaaagga

SEQ ID NO: 15149 - RNA, 36 nt, Artificial Sequence
  Description of Artificial Sequence:  Enzymatic Nucleic Acid
gcucaugauggcaugcacuaugcgcgacugcucauc

SEQ ID NO: 15150 - RNA, 36 nt, Artificial Sequence
  Description of Artificial Sequence:  Enzymatic Nucleic Acid
ccgcuugauggcaugcacuaugcgcgacacugcuca

SEQ ID NO: 15151 - RNA, 36 nt, Artificial Sequence
  Description of Artificial Sequence:  Enzymatic Nucleic Acid
ggcauugauggcaugcacuaugcgcgauaagggagc

SEQ ID NO: 15152 - RNA, 36 nt, Artificial Sequence
  Description of Artificial Sequence:  Enzymatic Nucleic Acid
gcuggugauggcaugcacuaugcgcgaucauaaggg

SEQ ID NO: 15153 - RNA, 36 nt, Artificial Sequence
  Description of Artificial Sequence:  Enzymatic Nucleic Acid
ccgggugauggcaugcacuaugcgcgaaacucccac

SEQ ID NO: 15154 - RNA, 36 nt, Artificial Sequence
  Description of Artificial Sequence:  Enzymatic Nucleic Acid
uccggugauggcaugcacuaugcgcgacguagguga

SEQ ID NO: 15155 - RNA, 36 nt, Artificial Sequence
  Description of Artificial Sequence:  Enzymatic Nucleic Acid
agccaugauggcaugcacuaugcgcgaguccggcac

SEQ ID NO: 15156 - RNA, 36 nt, Artificial Sequence
  Description of Artificial Sequence:  Enzymatic Nucleic Acid
uuucaugauggcaugcacuaugcgcgagccacaguc

SEQ ID NO: 15157 - RNA, 36 nt, Artificial Sequence
  Description of Artificial Sequence:  Enzymatic Nucleic Acid
auuuuugauggcaugcacuaugcgcgacagccacag

SEQ ID NO: 15158 - RNA, 36 nt, Artificial Sequence
  Description of Artificial Sequence:  Enzymatic Nucleic Acid
uucagugauggcaugcacuaugcgcgauuuucacag

SEQ ID NO: 15159 - RNA, 36 nt, Artificial Sequence
  Description of Artificial Sequence:  Enzymatic Nucleic Acid
ucuuuugauggcaugcacuaugcgcgagcauuuuca

SEQ ID NO: 15160 - RNA, 36 nt, Artificial Sequence
  Description of Artificial Sequence:  Enzymatic Nucleic Acid
guacuugauggcaugcacuaugcgcggcuggccgug

SEQ ID NO: 15161 - RNA, 36 nt, Artificial Sequence
  Description of Artificial Sequence:  Enzymatic Nucleic Acid
gucauugauggcaugcacuaugcgcgagagcuuugu

SEQ ID NO: 15162 - RNA, 36 nt, Artificial Sequence
  Description of Artificial Sequence:  Enzymatic Nucleic Acid
ucaguugauggcaugcacuaugcgcgaucagagcuu

SEQ ID NO: 15163 - RNA, 36 nt, Artificial Sequence
  Description of Artificial Sequence:  Enzymatic Nucleic Acid
uagcuugauggcaugcacuaugcgcgagucaucaga

SEQ ID NO: 15164 - RNA, 36 nt, Artificial Sequence
  Description of Artificial Sequence:  Enzymatic Nucleic Acid
uggguugauggcaugcacuaugcgcgaagauuuuua

SEQ ID NO: 15165 - RNA, 36 nt, Artificial Sequence
  Description of Artificial Sequence:  Enzymatic Nucleic Acid
acguuugauggcaugcacuaugcgcgagaugguggc

SEQ ID NO: 15166 - RNA, 36 nt, Artificial Sequence
  Description of Artificial Sequence:  Enzymatic Nucleic Acid
cccagugauggcaugcacuaugcgcgagguuaacca

SEQ ID NO: 15167 - RNA, 36 nt, Artificial Sequence
  Description of Artificial Sequence:  Enzymatic Nucleic Acid
uggugugauggcaugcacuaugcgcgaggcucccag

SEQ ID NO: 15168 - RNA, 36 nt, Artificial Sequence
  Description of Artificial Sequence:  Enzymatic Nucleic Acid
accauugauggcaugcacuaugcgcgagaggcccuc

SEQ ID NO: 15169 - RNA, 36 nt, Artificial Sequence
  Description of Artificial Sequence:  Enzymatic Nucleic Acid
acaauugauggcaugcacuaugcgcgaccaucagag

SEQ ID NO: 15170 - RNA, 36 nt, Artificial Sequence
  Description of Artificial Sequence:  Enzymatic Nucleic Acid
uucaaugauggcaugcacuaugcgcgaaucaccauc

SEQ ID NO: 15171 - RNA, 36 nt, Artificial Sequence
  Description of Artificial Sequence:  Enzymatic Nucleic Acid
guauuugauggcaugcacuaugcgcgaacaaucacc

SEQ ID NO: 15172 - RNA, 36 nt, Artificial Sequence
  Description of Artificial Sequence:  Enzymatic Nucleic Acid
auuugugauggcaugcacuaugcgcgaguauucaac

SEQ ID NO: 15173 - RNA, 36 nt, Artificial Sequence
  Description of Artificial Sequence:  Enzymatic Nucleic Acid
uaaguugauggcaugcacuaugcgcgacguuugcuc

SEQ ID NO: 15174 - RNA, 36 nt, Artificial Sequence
  Description of Artificial Sequence:  Enzymatic Nucleic Acid
ugcugugauggcaugcacuaugcgcgauccuuguug

SEQ ID NO: 15175 - RNA, 36 nt, Artificial Sequence
  Description of Artificial Sequence:  Enzymatic Nucleic Acid
gcuuuugauggcaugcacuaugcgcggcugcuggug

SEQ ID NO: 15176 - RNA, 36 nt, Artificial Sequence
  Description of Artificial Sequence:  Enzymatic Nucleic Acid
gcucgugauggcaugcacuaugcgcgaaagcuuucg

SEQ ID NO: 15177 - RNA, 36 nt, Artificial Sequence
  Description of Artificial Sequence:  Enzymatic Nucleic Acid
gagcuugauggcaugcacuaugcgcggcaaagcuuu

SEQ ID NO: 15178 - RNA, 36 nt, Artificial Sequence
  Description of Artificial Sequence:  Enzymatic Nucleic Acid
ucacuugauggcaugcacuaugcgcgagacuuuuau

SEQ ID NO: 15179 - RNA, 36 nt, Artificial Sequence
  Description of Artificial Sequence:  Enzymatic Nucleic Acid
aacauugauggcaugcacuaugcgcgacucagacuu

SEQ ID NO: 15180 - RNA, 36 nt, Artificial Sequence
  Description of Artificial Sequence:  Enzymatic Nucleic Acid
cucaaugauggcaugcacuaugcgcgaucacucaga

SEQ ID NO: 15181 - RNA, 36 nt, Artificial Sequence
  Description of Artificial Sequence:  Enzymatic Nucleic Acid
uuccuugauggcaugcacuaugcgcgaacaucacuc

SEQ ID NO: 15182 - RNA, 36 nt, Artificial Sequence
  Description of Artificial Sequence:  Enzymatic Nucleic Acid
accguugauggcaugcacuaugcgcgagaauccucc

SEQ ID NO: 15183 - RNA, 36 nt, Artificial Sequence
  Description of Artificial Sequence:  Enzymatic Nucleic Acid
gaaauugauggcaugcacuaugcgcgagaucuucca

SEQ ID NO: 15184 - RNA, 36 nt, Artificial Sequence
  Description of Artificial Sequence:  Enzymatic Nucleic Acid
gaagaugauggcaugcacuaugcgcgaggaacucca

SEQ ID NO: 15185 - RNA, 36 nt, Artificial Sequence
  Description of Artificial Sequence:  Enzymatic Nucleic Acid
gaaugugauggcaugcacuaugcgcgacuuucugga

SEQ ID NO: 15186 - RNA, 36 nt, Artificial Sequence
  Description of Artificial Sequence:  Enzymatic Nucleic Acid
uuucuugauggcaugcacuaugcgcggcugccaggu

SEQ ID NO: 15187 - RNA, 36 nt, Artificial Sequence
  Description of Artificial Sequence:  Enzymatic Nucleic Acid
guucuugauggcaugcacuaugcgcgagauaaaaga

SEQ ID NO: 15188 - RNA, 36 nt, Artificial Sequence
  Description of Artificial Sequence:  Enzymatic Nucleic Acid
aucuuugauggcaugcacuaugcgcgaccacguugu

SEQ ID NO: 15189 - RNA, 36 nt, Artificial Sequence
  Description of Artificial Sequence:  Enzymatic Nucleic Acid
aaucaugauggcaugcacuaugcgcgaaaucuucac

SEQ ID NO: 15190 - RNA, 36 nt, Artificial Sequence
  Description of Artificial Sequence:  Enzymatic Nucleic Acid
aaaauugauggcaugcacuaugcgcgacaaaucuuc

SEQ ID NO: 15191 - RNA, 36 nt, Artificial Sequence
  Description of Artificial Sequence:  Enzymatic Nucleic Acid
ccgggugauggcaugcacuaugcgcgaaggccaaaa

SEQ ID NO: 15192 - RNA, 36 nt, Artificial Sequence
  Description of Artificial Sequence:  Enzymatic Nucleic Acid
auaauugauggcaugcacuaugcgcggggguucuua

SEQ ID NO: 15193 - RNA, 36 nt, Artificial Sequence
  Description of Artificial Sequence:  Enzymatic Nucleic Acid
ucucaugauggcaugcacuaugcgcgauaaucgggg

SEQ ID NO: 15194 - RNA, 36 nt, Artificial Sequence
  Description of Artificial Sequence:  Enzymatic Nucleic Acid
uuucuugauggcaugcacuaugcgcgacauaaucgg

SEQ ID NO: 15195 - RNA, 36 nt, Artificial Sequence
  Description of Artificial Sequence:  Enzymatic Nucleic Acid
gaaguugauggcaugcacuaugcgcggaguaucucc

SEQ ID NO: 15196 - RNA, 36 nt, Artificial Sequence
  Description of Artificial Sequence:  Enzymatic Nucleic Acid
cauuuugauggcaugcacuaugcgcgagaggaaguc

SEQ ID NO: 15197 - RNA, 36 nt, Artificial Sequence
  Description of Artificial Sequence:  Enzymatic Nucleic Acid
agauuugauggcaugcacuaugcgcggggagccauc

SEQ ID NO: 15198 - RNA, 36 nt, Artificial Sequence
  Description of Artificial Sequence:  Enzymatic Nucleic Acid
uuuguugauggcaugcacuaugcgcgaaagauagau

SEQ ID NO: 15199 - RNA, 36 nt, Artificial Sequence
  Description of Artificial Sequence:  Enzymatic Nucleic Acid
cacguugauggcaugcacuaugcgcggcucuuggug

SEQ ID NO: 15200 - RNA, 36 nt, Artificial Sequence
  Description of Artificial Sequence:  Enzymatic Nucleic Acid
gaccaugauggcaugcacuaugcgcgacgucgcucu

SEQ ID NO: 15201 - RNA, 36 nt, Artificial Sequence
  Description of Artificial Sequence:  Enzymatic Nucleic Acid
cacagugauggcaugcacuaugcgcgaauacuccgu

SEQ ID NO: 15202 - RNA, 36 nt, Artificial Sequence
  Description of Artificial Sequence:  Enzymatic Nucleic Acid
ucccaugauggcaugcacuaugcgcgagcaauacuc

SEQ ID NO: 15203 - RNA, 36 nt, Artificial Sequence
  Description of Artificial Sequence:  Enzymatic Nucleic Acid
guccuugauggcaugcacuaugcgcgauccauuugu

SEQ ID NO: 15204 - RNA, 36 nt, Artificial Sequence
  Description of Artificial Sequence:  Enzymatic Nucleic Acid
gacugugauggcaugcacuaugcgcgaaaaguccuc

SEQ ID NO: 15205 - RNA, 36 nt, Artificial Sequence
  Description of Artificial Sequence:  Enzymatic Nucleic Acid
ucaggugauggcaugcacuaugcgcggacugcaaaa

SEQ ID NO: 15206 - RNA, 36 nt, Artificial Sequence
  Description of Artificial Sequence:  Enzymatic Nucleic Acid
ucccuugauggcaugcacuaugcgcgaggcgacugc

SEQ ID NO: 15207 - RNA, 36 nt, Artificial Sequence
  Description of Artificial Sequence:  Enzymatic Nucleic Acid
auccuugauggcaugcacuaugcgcgaugccuuccc

SEQ ID NO: 15208 - RNA, 36 nt, Artificial Sequence
  Description of Artificial Sequence:  Enzymatic Nucleic Acid
gcucuugauggcaugcacuaugcgcgauccucaugc

SEQ ID NO: 15209 - RNA, 36 nt, Artificial Sequence
  Description of Artificial Sequence:  Enzymatic Nucleic Acid
guacuugauggcaugcacuaugcgcgaggagcucuc

SEQ ID NO: 15210 - RNA, 36 nt, Artificial Sequence
  Description of Artificial Sequence:  Enzymatic Nucleic Acid
gauuuugauggcaugcacuaugcgcgaggaguagag

SEQ ID NO: 15211 - RNA, 36 nt, Artificial Sequence
  Description of Artificial Sequence:  Enzymatic Nucleic Acid
uccagugauggcaugcacuaugcgcgaugaucugau

SEQ ID NO: 15212 - RNA, 36 nt, Artificial Sequence
  Description of Artificial Sequence:  Enzymatic Nucleic Acid
gccagugauggcaugcacuaugcgcgaguccagcau

SEQ ID NO: 15213 - RNA, 36 nt, Artificial Sequence
  Description of Artificial Sequence:  Enzymatic Nucleic Acid
uucugugauggcaugcacuaugcgcgaaaucuuggc

SEQ ID NO: 15214 - RNA, 36 nt, Artificial Sequence
  Description of Artificial Sequence:  Enzymatic Nucleic Acid
uuccaugauggcaugcacuaugcgcgaaguucugca

SEQ ID NO: 15215 - RNA, 36 nt, Artificial Sequence
  Description of Artificial Sequence:  Enzymatic Nucleic Acid
caaauugauggcaugcacuaugcgcgaccuaguuuu

SEQ ID NO: 15216 - RNA, 36 nt, Artificial Sequence
  Description of Artificial Sequence:  Enzymatic Nucleic Acid
ugaagugauggcaugcacuaugcgcgaaaucaccua

SEQ ID NO: 15217 - RNA, 36 nt, Artificial Sequence
  Description of Artificial Sequence:  Enzymatic Nucleic Acid
uuguaugauggcaugcacuaugcgcgauuugcuuga

SEQ ID NO: 15218 - RNA, 36 nt, Artificial Sequence
  Description of Artificial Sequence:  Enzymatic Nucleic Acid
uauggugauggcaugcacuaugcgcgauugauuggg

SEQ ID NO: 15219 - RNA, 36 nt, Artificial Sequence
  Description of Artificial Sequence:  Enzymatic Nucleic Acid
ccuguugauggcaugcacuaugcgcgaguauggcau

SEQ ID NO: 15220 - RNA, 36 nt, Artificial Sequence
  Description of Artificial Sequence:  Enzymatic Nucleic Acid
gaaggugauggcaugcacuaugcgcgaggaguugag

SEQ ID NO: 15221 - RNA, 36 nt, Artificial Sequence
  Description of Artificial Sequence:  Enzymatic Nucleic Acid
guccuugauggcaugcacuaugcgcgagagaaggca

SEQ ID NO: 15222 - RNA, 36 nt, Artificial Sequence
  Description of Artificial Sequence:  Enzymatic Nucleic Acid
aacuuugauggcaugcacuaugcgcgggagcugaaa

SEQ ID NO: 15223 - RNA, 36 nt, Artificial Sequence
  Description of Artificial Sequence:  Enzymatic Nucleic Acid
aucauugauggcaugcacuaugcgcgagagcuuccu

SEQ ID NO: 15224 - RNA, 36 nt, Artificial Sequence
  Description of Artificial Sequence:  Enzymatic Nucleic Acid
gacauugauggcaugcacuaugcgcgaucagagcuu

SEQ ID NO: 15225 - RNA, 36 nt, Artificial Sequence
  Description of Artificial Sequence:  Enzymatic Nucleic Acid
ucugaugauggcaugcacuaugcgcgaucaucagag

SEQ ID NO: 15226 - RNA, 36 nt, Artificial Sequence
  Description of Artificial Sequence:  Enzymatic Nucleic Acid
auuuaugauggcaugcacuaugcgcgauaucugaca

SEQ ID NO: 15227 - RNA, 36 nt, Artificial Sequence
  Description of Artificial Sequence:  Enzymatic Nucleic Acid
gaaagugauggcaugcacuaugcgcgauuuacauau

SEQ ID NO: 15228 - RNA, 36 nt, Artificial Sequence
  Description of Artificial Sequence:  Enzymatic Nucleic Acid
aggcuugauggcaugcacuaugcgcgaugaacuuga

SEQ ID NO: 15229 - RNA, 36 nt, Artificial Sequence
  Description of Artificial Sequence:  Enzymatic Nucleic Acid
uucuuugauggcaugcacuaugcgcgaaagguuuug

SEQ ID NO: 15230 - RNA, 36 nt, Artificial Sequence
  Description of Artificial Sequence:  Enzymatic Nucleic Acid
gcauuugauggcaugcacuaugcgcggguaaaaguu

SEQ ID NO: 15231 - RNA, 36 nt, Artificial Sequence
  Description of Artificial Sequence:  Enzymatic Nucleic Acid
gguggugauggcaugcacuaugcgcgauucgguaaa

SEQ ID NO: 15232 - RNA, 36 nt, Artificial Sequence
  Description of Artificial Sequence:  Enzymatic Nucleic Acid
ucaaaugauggcaugcacuaugcgcgauggaggugg

SEQ ID NO: 15233 - RNA, 36 nt, Artificial Sequence
  Description of Artificial Sequence:  Enzymatic Nucleic Acid
gucauugauggcaugcacuaugcgcgaaacauggag

SEQ ID NO: 15234 - RNA, 36 nt, Artificial Sequence
  Description of Artificial Sequence:  Enzymatic Nucleic Acid
guaguugauggcaugcacuaugcgcgaucaaacaug

SEQ ID NO: 15235 - RNA, 36 nt, Artificial Sequence
  Description of Artificial Sequence:  Enzymatic Nucleic Acid
gcuguugauggcaugcacuaugcgcggcccugguag

SEQ ID NO: 15236 - RNA, 36 nt, Artificial Sequence
  Description of Artificial Sequence:  Enzymatic Nucleic Acid
gccaaugauggcaugcacuaugcgcgagagugcugc

SEQ ID NO: 15237 - RNA, 36 nt, Artificial Sequence
  Description of Artificial Sequence:  Enzymatic Nucleic Acid
uucagugauggcaugcacuaugcgcgaugggagagg

SEQ ID NO: 15238 - RNA, 36 nt, Artificial Sequence
  Description of Artificial Sequence:  Enzymatic Nucleic Acid
cgcuuugauggcaugcacuaugcgcgagcaugggag

SEQ ID NO: 15239 - RNA, 36 nt, Artificial Sequence
  Description of Artificial Sequence:  Enzymatic Nucleic Acid
ugaagugauggcaugcacuaugcgcggcuucagcau

SEQ ID NO: 15240 - RNA, 36 nt, Artificial Sequence
  Description of Artificial Sequence:  Enzymatic Nucleic Acid
gcuguugauggcaugcacuaugcgcgaguccaggug

SEQ ID NO: 15241 - RNA, 36 nt, Artificial Sequence
  Description of Artificial Sequence:  Enzymatic Nucleic Acid
uugagugauggcaugcacuaugcgcggaggccuugg

SEQ ID NO: 15242 - RNA, 36 nt, Artificial Sequence
  Description of Artificial Sequence:  Enzymatic Nucleic Acid
caaguugauggcaugcacuaugcgcgaaucuugagc

SEQ ID NO: 15243 - RNA, 36 nt, Artificial Sequence
  Description of Artificial Sequence:  Enzymatic Nucleic Acid
acucuugauggcaugcacuaugcgcgaagucaaucu

SEQ ID NO: 15244 - RNA, 36 nt, Artificial Sequence
  Description of Artificial Sequence:  Enzymatic Nucleic Acid
ucagaugauggcaugcacuaugcgcgagccccgacu

SEQ ID NO: 15245 - RNA, 36 nt, Artificial Sequence
  Description of Artificial Sequence:  Enzymatic Nucleic Acid
gacauugauggcaugcacuaugcgcgagacagcccc

SEQ ID NO: 15246 - RNA, 36 nt, Artificial Sequence
  Description of Artificial Sequence:  Enzymatic Nucleic Acid
gcugaugauggcaugcacuaugcgcgaucagacagc

SEQ ID NO: 15247 - RNA, 36 nt, Artificial Sequence
  Description of Artificial Sequence:  Enzymatic Nucleic Acid
aauggugauggcaugcacuaugcgcgagaaacuggg

SEQ ID NO: 15248 - RNA, 36 nt, Artificial Sequence
  Description of Artificial Sequence:  Enzymatic Nucleic Acid
gcccaugauggcaugcacuaugcgcgagcuggaaug

SEQ ID NO: 15249 - RNA, 36 nt, Artificial Sequence
  Description of Artificial Sequence:  Enzymatic Nucleic Acid
gccuuugauggcaugcacuaugcgcggcugacgugc

SEQ ID NO: 15250 - RNA, 36 nt, Artificial Sequence
  Description of Artificial Sequence:  Enzymatic Nucleic Acid
accugugauggcaugcacuaugcgcggcuugccuuc

SEQ ID NO: 15251 - RNA, 36 nt, Artificial Sequence
  Description of Artificial Sequence:  Enzymatic Nucleic Acid
gugguugauggcaugcacuaugcgcgguaggugaac

SEQ ID NO: 15252 - RNA, 36 nt, Artificial Sequence
  Description of Artificial Sequence:  Enzymatic Nucleic Acid
cucagugauggcaugcacuaugcgcgguggucguag

SEQ ID NO: 15253 - RNA, 36 nt, Artificial Sequence
  Description of Artificial Sequence:  Enzymatic Nucleic Acid
cagcuugauggcaugcacuaugcgcgagcguggucg

SEQ ID NO: 15254 - RNA, 36 nt, Artificial Sequence
  Description of Artificial Sequence:  Enzymatic Nucleic Acid
gcacgugauggcaugcacuaugcgcggauuuuccuu

SEQ ID NO: 15255 - RNA, 36 nt, Artificial Sequence
  Description of Artificial Sequence:  Enzymatic Nucleic Acid
agcagugauggcaugcacuaugcgcgacgcgauuuu

SEQ ID NO: 15256 - RNA, 36 nt, Artificial Sequence
  Description of Artificial Sequence:  Enzymatic Nucleic Acid
gggagugauggcaugcacuaugcgcgagcacgcgau

SEQ ID NO: 15257 - RNA, 36 nt, Artificial Sequence
  Description of Artificial Sequence:  Enzymatic Nucleic Acid
gggggugauggcaugcacuaugcgcgggggagcagc

SEQ ID NO: 15258 - RNA, 36 nt, Artificial Sequence
  Description of Artificial Sequence:  Enzymatic Nucleic Acid
gaguaugauggcaugcacuaugcgcgaggaccaccg

SEQ ID NO: 15259 - RNA, 36 nt, Artificial Sequence
  Description of Artificial Sequence:  Enzymatic Nucleic Acid
cguguugauggcaugcacuaugcgcgaaacucuaga

SEQ ID NO: 15260 - RNA, 36 nt, Artificial Sequence
  Description of Artificial Sequence:  Enzymatic Nucleic Acid
ggcuuugauggcaugcacuaugcgcggugucaaacu

SEQ ID NO: 15261 - RNA, 36 nt, Artificial Sequence
  Description of Artificial Sequence:  Enzymatic Nucleic Acid
auacaugauggcaugcacuaugcgcgaugugcuucu

SEQ ID NO: 15262 - RNA, 36 nt, Artificial Sequence
  Description of Artificial Sequence:  Enzymatic Nucleic Acid
aaauaugauggcaugcacuaugcgcgacaugugcuu

SEQ ID NO: 15263 - RNA, 36 nt, Artificial Sequence
  Description of Artificial Sequence:  Enzymatic Nucleic Acid
acuggugauggcaugcacuaugcgcgaaaagcuagu

SEQ ID NO: 15264 - RNA, 36 nt, Artificial Sequence
  Description of Artificial Sequence:  Enzymatic Nucleic Acid
auaugugauggcaugcacuaugcgcgauaauacugg

SEQ ID NO: 15265 - RNA, 36 nt, Artificial Sequence
  Description of Artificial Sequence:  Enzymatic Nucleic Acid
aaaagugauggcaugcacuaugcgcgagcuggcucc

SEQ ID NO: 15266 - RNA, 36 nt, Artificial Sequence
  Description of Artificial Sequence:  Enzymatic Nucleic Acid
aaucaugauggcaugcacuaugcgcgaaaaagcagc

SEQ ID NO: 15267 - RNA, 36 nt, Artificial Sequence
  Description of Artificial Sequence:  Enzymatic Nucleic Acid
aaaauugauggcaugcacuaugcgcgacaaaaagca

SEQ ID NO: 15268 - RNA, 36 nt, Artificial Sequence
  Description of Artificial Sequence:  Enzymatic Nucleic Acid
aaaagugauggcaugcacuaugcgcgacuauuaaaa

SEQ ID NO: 15269 - RNA, 36 nt, Artificial Sequence
  Description of Artificial Sequence:  Enzymatic Nucleic Acid
uuaguugauggcaugcacuaugcgcgaaaaaaaaaa

SEQ ID NO: 15270 - RNA, 36 nt, Artificial Sequence
  Description of Artificial Sequence:  Enzymatic Nucleic Acid
aguuaugauggcaugcacuaugcgcgauucuuguua

SEQ ID NO: 15271 - RNA, 36 nt, Artificial Sequence
  Description of Artificial Sequence:  Enzymatic Nucleic Acid
cuuguugauggcaugcacuaugcgcgacuauuucuc

SEQ ID NO: 15272 - RNA, 36 nt, Artificial Sequence
  Description of Artificial Sequence:  Enzymatic Nucleic Acid
uucuuugauggcaugcacuaugcgcgacuugucacu

SEQ ID NO: 15273 - RNA, 36 nt, Artificial Sequence
  Description of Artificial Sequence:  Enzymatic Nucleic Acid
uuuagugauggcaugcacuaugcgcgaguaguguuc

SEQ ID NO: 15274 - RNA, 36 nt, Artificial Sequence
  Description of Artificial Sequence:  Enzymatic Nucleic Acid
aguaaugauggcaugcacuaugcgcgaugaggauuu

SEQ ID NO: 15275 - RNA, 36 nt, Artificial Sequence
  Description of Artificial Sequence:  Enzymatic Nucleic Acid
ucuaaugauggcaugcacuaugcgcgacugaguaac

SEQ ID NO: 15276 - RNA, 36 nt, Artificial Sequence
  Description of Artificial Sequence:  Enzymatic Nucleic Acid
gaaguugauggcaugcacuaugcgcgauuggguuua

SEQ ID NO: 15277 - RNA, 36 nt, Artificial Sequence
  Description of Artificial Sequence:  Enzymatic Nucleic Acid
uggagugauggcaugcacuaugcgcgagggaaguca

SEQ ID NO: 15278 - RNA, 36 nt, Artificial Sequence
  Description of Artificial Sequence:  Enzymatic Nucleic Acid
gguggugauggcaugcacuaugcgcgggggguugga

SEQ ID NO: 15279 - RNA, 36 nt, Artificial Sequence
  Description of Artificial Sequence:  Enzymatic Nucleic Acid
uccugugauggcaugcacuaugcgcggugcccugag

SEQ ID NO: 15280 - RNA, 36 nt, Artificial Sequence
  Description of Artificial Sequence:  Enzymatic Nucleic Acid
ucaauugauggcaugcacuaugcgcgaaacuggucc

SEQ ID NO: 15281 - RNA, 36 nt, Artificial Sequence
  Description of Artificial Sequence:  Enzymatic Nucleic Acid
cuccuugauggcaugcacuaugcgcgaaucaaacug

SEQ ID NO: 15282 - RNA, 36 nt, Artificial Sequence
  Description of Artificial Sequence:  Enzymatic Nucleic Acid
cagugugauggcaugcacuaugcgcgagcuccucaa

SEQ ID NO: 15283 - RNA, 36 nt, Artificial Sequence
  Description of Artificial Sequence:  Enzymatic Nucleic Acid
gugauugauggcaugcacuaugcgcgagugcagcuc

SEQ ID NO: 15284 - RNA, 36 nt, Artificial Sequence
  Description of Artificial Sequence:  Enzymatic Nucleic Acid
ugaugugauggcaugcacuaugcgcgauugggugau

SEQ ID NO: 15285 - RNA, 36 nt, Artificial Sequence
  Description of Artificial Sequence:  Enzymatic Nucleic Acid
ggcugugauggcaugcacuaugcgcgagggcuggcc

SEQ ID NO: 15286 - RNA, 36 nt, Artificial Sequence
  Description of Artificial Sequence:  Enzymatic Nucleic Acid
uugcuugauggcaugcacuaugcgcgaggccagcca

SEQ ID NO: 15287 - RNA, 36 nt, Artificial Sequence
  Description of Artificial Sequence:  Enzymatic Nucleic Acid
ccucaugauggcaugcacuaugcgcgaugucuuagg

SEQ ID NO: 15288 - RNA, 36 nt, Artificial Sequence
  Description of Artificial Sequence:  Enzymatic Nucleic Acid
cuccuugauggcaugcacuaugcgcgacaugucuua

SEQ ID NO: 15289 - RNA, 36 nt, Artificial Sequence
  Description of Artificial Sequence:  Enzymatic Nucleic Acid
uuucuugauggcaugcacuaugcgcgaugccuucuc

SEQ ID NO: 15290 - RNA, 36 nt, Artificial Sequence
  Description of Artificial Sequence:  Enzymatic Nucleic Acid
cgucuugauggcaugcacuaugcgcgaaauucuuuc

SEQ ID NO: 15291 - RNA, 36 nt, Artificial Sequence
  Description of Artificial Sequence:  Enzymatic Nucleic Acid
uggugugauggcaugcacuaugcgcggucucaaauu

SEQ ID NO: 15292 - RNA, 36 nt, Artificial Sequence
  Description of Artificial Sequence:  Enzymatic Nucleic Acid
gcccaugauggcaugcacuaugcgcgauggugcguc

SEQ ID NO: 15293 - RNA, 36 nt, Artificial Sequence
  Description of Artificial Sequence:  Enzymatic Nucleic Acid
aauggugauggcaugcacuaugcgcgauugcugagc

SEQ ID NO: 15294 - RNA, 36 nt, Artificial Sequence
  Description of Artificial Sequence:  Enzymatic Nucleic Acid
aggguugauggcaugcacuaugcgcgagagcuggga

SEQ ID NO: 15295 - RNA, 36 nt, Artificial Sequence
  Description of Artificial Sequence:  Enzymatic Nucleic Acid
gcccuugauggcaugcacuaugcgcgaaauguagaa

SEQ ID NO: 15296 - RNA, 36 nt, Artificial Sequence
  Description of Artificial Sequence:  Enzymatic Nucleic Acid
cucauugauggcaugcacuaugcgcggcuguccauc

SEQ ID NO: 15297 - RNA, 36 nt, Artificial Sequence
  Description of Artificial Sequence:  Enzymatic Nucleic Acid
ccccuugauggcaugcacuaugcgcgaucgcugucc

SEQ ID NO: 15298 - RNA, 36 nt, Artificial Sequence
  Description of Artificial Sequence:  Enzymatic Nucleic Acid
auggaugauggcaugcacuaugcgcgauagaaccac

SEQ ID NO: 15299 - RNA, 36 nt, Artificial Sequence
  Description of Artificial Sequence:  Enzymatic Nucleic Acid
caaaaugauggcaugcacuaugcgcgaugccacgaa

SEQ ID NO: 15300 - RNA, 36 nt, Artificial Sequence
  Description of Artificial Sequence:  Enzymatic Nucleic Acid
caaauugauggcaugcacuaugcgcgaaaacaugcc

SEQ ID NO: 15301 - RNA, 36 nt, Artificial Sequence
  Description of Artificial Sequence:  Enzymatic Nucleic Acid
ugcuaugauggcaugcacuaugcgcgaaaucaaaac

SEQ ID NO: 15302 - RNA, 36 nt, Artificial Sequence
  Description of Artificial Sequence:  Enzymatic Nucleic Acid
acccuugauggcaugcacuaugcgcgagugcuacaa

SEQ ID NO: 15303 - RNA, 36 nt, Artificial Sequence
  Description of Artificial Sequence:  Enzymatic Nucleic Acid
gggcuugauggcaugcacuaugcgcgagaguugagu

SEQ ID NO: 15304 - RNA, 36 nt, Artificial Sequence
  Description of Artificial Sequence:  Enzymatic Nucleic Acid
cagugugauggcaugcacuaugcgcgaucuuacuag

SEQ ID NO: 15305 - RNA, 36 nt, Artificial Sequence
  Description of Artificial Sequence:  Enzymatic Nucleic Acid
guuuuugauggcaugcacuaugcgcgagugcaucuu

SEQ ID NO: 15306 - RNA, 36 nt, Artificial Sequence
  Description of Artificial Sequence:  Enzymatic Nucleic Acid
ggagaugauggcaugcacuaugcgcgaaccuaacuc

SEQ ID NO: 15307 - RNA, 36 nt, Artificial Sequence
  Description of Artificial Sequence:  Enzymatic Nucleic Acid
gccauugauggcaugcacuaugcgcgauggccugga

SEQ ID NO: 15308 - RNA, 36 nt, Artificial Sequence
  Description of Artificial Sequence:  Enzymatic Nucleic Acid
auuuuugauggcaugcacuaugcgcgaguguaaggc

SEQ ID NO: 15309 - RNA, 36 nt, Artificial Sequence
  Description of Artificial Sequence:  Enzymatic Nucleic Acid
ugugaugauggcaugcacuaugcgcgauuuucagug

SEQ ID NO: 15310 - RNA, 36 nt, Artificial Sequence
  Description of Artificial Sequence:  Enzymatic Nucleic Acid
caaaaugauggcaugcacuaugcgcgagaauaauac

SEQ ID NO: 15311 - RNA, 36 nt, Artificial Sequence
  Description of Artificial Sequence:  Enzymatic Nucleic Acid
cugugugauggcaugcacuaugcgcgaaaacagaau

SEQ ID NO: 15312 - RNA, 36 nt, Artificial Sequence
  Description of Artificial Sequence:  Enzymatic Nucleic Acid
uuucaugauggcaugcacuaugcgcgaacuaacugu

SEQ ID NO: 15313 - RNA, 36 nt, Artificial Sequence
  Description of Artificial Sequence:  Enzymatic Nucleic Acid
ucuuuugauggcaugcacuaugcgcgacaacuaacu

SEQ ID NO: 15314 - RNA, 36 nt, Artificial Sequence
  Description of Artificial Sequence:  Enzymatic Nucleic Acid
cuucuugauggcaugcacuaugcgcgagcuuucuuu

SEQ ID NO: 15315 - RNA, 36 nt, Artificial Sequence
  Description of Artificial Sequence:  Enzymatic Nucleic Acid
auuuuugauggcaugcacuaugcgcgauucuucuca

SEQ ID NO: 15316 - RNA, 36 nt, Artificial Sequence
  Description of Artificial Sequence:  Enzymatic Nucleic Acid
gacugugauggcaugcacuaugcgcgauuuucauuc

SEQ ID NO: 15317 - RNA, 36 nt, Artificial Sequence
  Description of Artificial Sequence:  Enzymatic Nucleic Acid
cuccuugauggcaugcacuaugcgcgaggacugcau

SEQ ID NO: 15318 - RNA, 36 nt, Artificial Sequence
  Description of Artificial Sequence:  Enzymatic Nucleic Acid
gcccuugauggcaugcacuaugcgcgguuuugauau

SEQ ID NO: 15319 - RNA, 36 nt, Artificial Sequence
  Description of Artificial Sequence:  Enzymatic Nucleic Acid
uccauugauggcaugcacuaugcgcgagcccucguu

SEQ ID NO: 15320 - RNA, 36 nt, Artificial Sequence
  Description of Artificial Sequence:  Enzymatic Nucleic Acid
ccuuuugauggcaugcacuaugcgcgagauuagugu

SEQ ID NO: 15321 - RNA, 36 nt, Artificial Sequence
  Description of Artificial Sequence:  Enzymatic Nucleic Acid
uuccaugauggcaugcacuaugcgcgauccuuucag

SEQ ID NO: 15322 - RNA, 36 nt, Artificial Sequence
  Description of Artificial Sequence:  Enzymatic Nucleic Acid
auaugugauggcaugcacuaugcgcggccagcuaau

SEQ ID NO: 15323 - RNA, 36 nt, Artificial Sequence
  Description of Artificial Sequence:  Enzymatic Nucleic Acid
uuacuugauggcaugcacuaugcgcgaaggagcuua

SEQ ID NO: 15324 - RNA, 36 nt, Artificial Sequence
  Description of Artificial Sequence:  Enzymatic Nucleic Acid
aauuaugauggcaugcacuaugcgcgauaccaccuu

SEQ ID NO: 15325 - RNA, 36 nt, Artificial Sequence
  Description of Artificial Sequence:  Enzymatic Nucleic Acid
ccuugugauggcaugcacuaugcgcgauaaauuaca

SEQ ID NO: 15326 - RNA, 36 nt, Artificial Sequence
  Description of Artificial Sequence:  Enzymatic Nucleic Acid
uggcuugauggcaugcacuaugcgcgauuaacuaau

SEQ ID NO: 15327 - RNA, 36 nt, Artificial Sequence
  Description of Artificial Sequence:  Enzymatic Nucleic Acid
caaagugauggcaugcacuaugcgcgaguugaaaau

SEQ ID NO: 15328 - RNA, 36 nt, Artificial Sequence
  Description of Artificial Sequence:  Enzymatic Nucleic Acid
aguuuugauggcaugcacuaugcgcgaaagcaguug

SEQ ID NO: 15329 - RNA, 36 nt, Artificial Sequence
  Description of Artificial Sequence:  Enzymatic Nucleic Acid
ccaggugauggcaugcacuaugcgcgaaguuucaaa

SEQ ID NO: 15330 - RNA, 36 nt, Artificial Sequence
  Description of Artificial Sequence:  Enzymatic Nucleic Acid
augcuugauggcaugcacuaugcgcgagaccccagg

SEQ ID NO: 15331 - RNA, 36 nt, Artificial Sequence
  Description of Artificial Sequence:  Enzymatic Nucleic Acid
cccauugauggcaugcacuaugcgcgaugcucagac

SEQ ID NO: 15332 - RNA, 36 nt, Artificial Sequence
  Description of Artificial Sequence:  Enzymatic Nucleic Acid
guaggugauggcaugcacuaugcgcggcccuuuccu

SEQ ID NO: 15333 - RNA, 36 nt, Artificial Sequence
  Description of Artificial Sequence:  Enzymatic Nucleic Acid
cuuagugauggcaugcacuaugcgcggauccaaggc

SEQ ID NO: 15334 - RNA, 36 nt, Artificial Sequence
  Description of Artificial Sequence:  Enzymatic Nucleic Acid
ucaaaugauggcaugcacuaugcgcgagagccagcu

SEQ ID NO: 15335 - RNA, 36 nt, Artificial Sequence
  Description of Artificial Sequence:  Enzymatic Nucleic Acid
agcauugauggcaugcacuaugcgcgaaacagagcc

SEQ ID NO: 15336 - RNA, 36 nt, Artificial Sequence
  Description of Artificial Sequence:  Enzymatic Nucleic Acid
aauagugauggcaugcacuaugcgcgaucaaacaga

SEQ ID NO: 15337 - RNA, 36 nt, Artificial Sequence
  Description of Artificial Sequence:  Enzymatic Nucleic Acid
acuugugauggcaugcacuaugcgcgauaaauagca

SEQ ID NO: 15338 - RNA, 36 nt, Artificial Sequence
  Description of Artificial Sequence:  Enzymatic Nucleic Acid
aaauaugauggcaugcacuaugcgcgauagacccua

SEQ ID NO: 15339 - RNA, 36 nt, Artificial Sequence
  Description of Artificial Sequence:  Enzymatic Nucleic Acid
aggcgugauggcaugcacuaugcgcgauccuaaaua

SEQ ID NO: 15340 - RNA, 36 nt, Artificial Sequence
  Description of Artificial Sequence:  Enzymatic Nucleic Acid
guaggugauggcaugcacuaugcgcggcauccuaaa

SEQ ID NO: 15341 - RNA, 36 nt, Artificial Sequence
  Description of Artificial Sequence:  Enzymatic Nucleic Acid
gcagaugauggcaugcacuaugcgcgauccuaaaua

SEQ ID NO: 15342 - RNA, 36 nt, Artificial Sequence
  Description of Artificial Sequence:  Enzymatic Nucleic Acid
aggugugauggcaugcacuaugcgcgagacauccua

SEQ ID NO: 15343 - RNA, 36 nt, Artificial Sequence
  Description of Artificial Sequence:  Enzymatic Nucleic Acid
ggcugugauggcaugcacuaugcgcgagaaggugca

SEQ ID NO: 15344 - RNA, 36 nt, Artificial Sequence
  Description of Artificial Sequence:  Enzymatic Nucleic Acid
agcagugauggcaugcacuaugcgcgaauccacugu

SEQ ID NO: 15345 - RNA, 36 nt, Artificial Sequence
  Description of Artificial Sequence:  Enzymatic Nucleic Acid
agaagugauggcaugcacuaugcgcgagcaauccac

SEQ ID NO: 15346 - RNA, 36 nt, Artificial Sequence
  Description of Artificial Sequence:  Enzymatic Nucleic Acid
ggaagugauggcaugcacuaugcgcgauacucuucu

SEQ ID NO: 15347 - RNA, 36 nt, Artificial Sequence
  Description of Artificial Sequence:  Enzymatic Nucleic Acid
aauuaugauggcaugcacuaugcgcgauggauaaaa

SEQ ID NO: 15348 - RNA, 36 nt, Artificial Sequence
  Description of Artificial Sequence:  Enzymatic Nucleic Acid
uucuaugauggcaugcacuaugcgcgaguuaaauua

SEQ ID NO: 15349 - RNA, 36 nt, Artificial Sequence
  Description of Artificial Sequence:  Enzymatic Nucleic Acid
gagcuugauggcaugcacuaugcgcgagguucuaca

SEQ ID NO: 15350 - RNA, 36 nt, Artificial Sequence
  Description of Artificial Sequence:  Enzymatic Nucleic Acid
uucuuugauggcaugcacuaugcgcggguuacuuag

SEQ ID NO: 15351 - RNA, 36 nt, Artificial Sequence
  Description of Artificial Sequence:  Enzymatic Nucleic Acid
gcauaugauggcaugcacuaugcgcgauucuucggu

SEQ ID NO: 15352 - RNA, 36 nt, Artificial Sequence
  Description of Artificial Sequence:  Enzymatic Nucleic Acid
agaggugauggcaugcacuaugcgcgauacauucuu

SEQ ID NO: 15353 - RNA, 36 nt, Artificial Sequence
  Description of Artificial Sequence:  Enzymatic Nucleic Acid
aagaaugauggcaugcacuaugcgcgagaggcauac

SEQ ID NO: 15354 - RNA, 36 nt, Artificial Sequence
  Description of Artificial Sequence:  Enzymatic Nucleic Acid
uggcaugauggcaugcacuaugcgcgauaagaacag

SEQ ID NO: 15355 - RNA, 36 nt, Artificial Sequence
  Description of Artificial Sequence:  Enzymatic Nucleic Acid
uguggugauggcaugcacuaugcgcgacauaagaac

SEQ ID NO: 15356 - RNA, 36 nt, Artificial Sequence
  Description of Artificial Sequence:  Enzymatic Nucleic Acid
uuaaaugauggcaugcacuaugcgcgaaggaugugg

SEQ ID NO: 15357 - RNA, 36 nt, Artificial Sequence
  Description of Artificial Sequence:  Enzymatic Nucleic Acid
ucauaugauggcaugcacuaugcgcgagagagccuu

SEQ ID NO: 15358 - RNA, 36 nt, Artificial Sequence
  Description of Artificial Sequence:  Enzymatic Nucleic Acid
cucuuugauggcaugcacuaugcgcgauacagagag

SEQ ID NO: 15359 - RNA, 36 nt, Artificial Sequence
  Description of Artificial Sequence:  Enzymatic Nucleic Acid
aggcuugauggcaugcacuaugcgcgacuagggaau

SEQ ID NO: 15360 - RNA, 36 nt, Artificial Sequence
  Description of Artificial Sequence:  Enzymatic Nucleic Acid
uuccaugauggcaugcacuaugcgcgaaaagccgcu

SEQ ID NO: 15361 - RNA, 36 nt, Artificial Sequence
  Description of Artificial Sequence:  Enzymatic Nucleic Acid
aacaaugauggcaugcacuaugcgcgaaagauuugu

SEQ ID NO: 15362 - RNA, 36 nt, Artificial Sequence
  Description of Artificial Sequence:  Enzymatic Nucleic Acid
aggaaugauggcaugcacuaugcgcgaacaaagauu

SEQ ID NO: 15363 - RNA, 36 nt, Artificial Sequence
  Description of Artificial Sequence:  Enzymatic Nucleic Acid
guuugugauggcaugcacuaugcgcgguauguguaa

SEQ ID NO: 15364 - RNA, 36 nt, Artificial Sequence
  Description of Artificial Sequence:  Enzymatic Nucleic Acid
ugucaugauggcaugcacuaugcgcgaggugguuug

SEQ ID NO: 15365 - RNA, 36 nt, Artificial Sequence
  Description of Artificial Sequence:  Enzymatic Nucleic Acid
gcuguugauggcaugcacuaugcgcgacaggugguu

SEQ ID NO: 15366 - RNA, 36 nt, Artificial Sequence
  Description of Artificial Sequence:  Enzymatic Nucleic Acid
guuauugauggcaugcacuaugcgcgacuauuugcu

SEQ ID NO: 15367 - RNA, 36 nt, Artificial Sequence
  Description of Artificial Sequence:  Enzymatic Nucleic Acid
augaaugauggcaugcacuaugcgcgagcuaagguu

SEQ ID NO: 15368 - RNA, 36 nt, Artificial Sequence
  Description of Artificial Sequence:  Enzymatic Nucleic Acid
caagaugauggcaugcacuaugcgcgaugaacagcu

SEQ ID NO: 15369 - RNA, 36 nt, Artificial Sequence
  Description of Artificial Sequence:  Enzymatic Nucleic Acid
gaaauugauggcaugcacuaugcgcgaagacaugaa

SEQ ID NO: 15370 - RNA, 36 nt, Artificial Sequence
  Description of Artificial Sequence:  Enzymatic Nucleic Acid
aguaaugauggcaugcacuaugcgcgaauucuaaug

SEQ ID NO: 15371 - RNA, 36 nt, Artificial Sequence
  Description of Artificial Sequence:  Enzymatic Nucleic Acid
ugcuaugauggcaugcacuaugcgcgaaaccugagu

SEQ ID NO: 15372 - RNA, 36 nt, Artificial Sequence
  Description of Artificial Sequence:  Enzymatic Nucleic Acid
ggacuugauggcaugcacuaugcgcgauguaugcua

SEQ ID NO: 15373 - RNA, 36 nt, Artificial Sequence
  Description of Artificial Sequence:  Enzymatic Nucleic Acid
uucuaugauggcaugcacuaugcgcgauuaagacuc

SEQ ID NO: 15374 - RNA, 36 nt, Artificial Sequence
  Description of Artificial Sequence:  Enzymatic Nucleic Acid
uauuaugauggcaugcacuaugcgcgaagucuccau

SEQ ID NO: 15375 - RNA, 36 nt, Artificial Sequence
  Description of Artificial Sequence:  Enzymatic Nucleic Acid
uagcuugauggcaugcacuaugcgcgauuauuacaa

SEQ ID NO: 15376 - RNA, 36 nt, Artificial Sequence
  Description of Artificial Sequence:  Enzymatic Nucleic Acid
acaagugauggcaugcacuaugcgcgacuuuguaac

SEQ ID NO: 15377 - RNA, 36 nt, Artificial Sequence
  Description of Artificial Sequence:  Enzymatic Nucleic Acid
augaaugauggcaugcacuaugcgcgaagcacuuug

SEQ ID NO: 15378 - RNA, 36 nt, Artificial Sequence
  Description of Artificial Sequence:  Enzymatic Nucleic Acid
auuuuugauggcaugcacuaugcgcgagugcuauuu

SEQ ID NO: 15379 - RNA, 36 nt, Artificial Sequence
  Description of Artificial Sequence:  Enzymatic Nucleic Acid
uguuuugauggcaugcacuaugcgcgaauuuucagu

SEQ ID NO: 15380 - RNA, 36 nt, Artificial Sequence
  Description of Artificial Sequence:  Enzymatic Nucleic Acid
uaauuugauggcaugcacuaugcgcgauguuucaau

SEQ ID NO: 15381 - RNA, 36 nt, Artificial Sequence
  Description of Artificial Sequence:  Enzymatic Nucleic Acid
auuauugauggcaugcacuaugcgcgaguuaauuca

SEQ ID NO: 15382 - RNA, 36 nt, Artificial Sequence
  Description of Artificial Sequence:  Enzymatic Nucleic Acid
aauggugauggcaugcacuaugcgcgaaaugauugg

SEQ ID NO: 15383 - RNA, 36 nt, Artificial Sequence
  Description of Artificial Sequence:  Enzymatic Nucleic Acid
uuuguugauggcaugcacuaugcgcgauaaauggca

SEQ ID NO: 15384 - RNA, 36 nt, Artificial Sequence
  Description of Artificial Sequence:  Enzymatic Nucleic Acid
gugcuugauggcaugcacuaugcgcgguucuuuguu

SEQ ID NO: 15385 - RNA, 36 nt, Artificial Sequence
  Description of Artificial Sequence:  Enzymatic Nucleic Acid
uaucuugauggcaugcacuaugcgcgagaaacucug

SEQ ID NO: 15386 - RNA, 36 nt, Artificial Sequence
  Description of Artificial Sequence:  Enzymatic Nucleic Acid
acguaugauggcaugcacuaugcgcgauuaucucag

SEQ ID NO: 15387 - RNA, 36 nt, Artificial Sequence
  Description of Artificial Sequence:  Enzymatic Nucleic Acid
gguuuugauggcaugcacuaugcgcgagccccauuc

SEQ ID NO: 15388 - RNA, 36 nt, Artificial Sequence
  Description of Artificial Sequence:  Enzymatic Nucleic Acid
uugcaugauggcaugcacuaugcgcgaugguuucag

SEQ ID NO: 15389 - RNA, 36 nt, Artificial Sequence
  Description of Artificial Sequence:  Enzymatic Nucleic Acid
acuugugauggcaugcacuaugcgcgacaugguuuc

SEQ ID NO: 15390 - RNA, 36 nt, Artificial Sequence
  Description of Artificial Sequence:  Enzymatic Nucleic Acid
agacaugauggcaugcacuaugcgcgagacuugcac

SEQ ID NO: 15391 - RNA, 36 nt, Artificial Sequence
  Description of Artificial Sequence:  Enzymatic Nucleic Acid
caagaugauggcaugcacuaugcgcgacagacuugc

SEQ ID NO: 15392 - RNA, 36 nt, Artificial Sequence
  Description of Artificial Sequence:  Enzymatic Nucleic Acid
acugaugauggcaugcacuaugcgcgaagacacaga

SEQ ID NO: 15393 - RNA, 36 nt, Artificial Sequence
  Description of Artificial Sequence:  Enzymatic Nucleic Acid
gguguugauggcaugcacuaugcgcgacuucuugga

SEQ ID NO: 15394 - RNA, 36 nt, Artificial Sequence
  Description of Artificial Sequence:  Enzymatic Nucleic Acid
caucuugauggcaugcacuaugcgcgggugucacuu

SEQ ID NO: 15395 - RNA, 36 nt, Artificial Sequence
  Description of Artificial Sequence:  Enzymatic Nucleic Acid
auuaaugauggcaugcacuaugcgcgaucucggugu

SEQ ID NO: 15396 - RNA, 36 nt, Artificial Sequence
  Description of Artificial Sequence:  Enzymatic Nucleic Acid
caaggugauggcaugcacuaugcgcgacgggucccu

SEQ ID NO: 15397 - RNA, 36 nt, Artificial Sequence
  Description of Artificial Sequence:  Enzymatic Nucleic Acid
ggaaaugauggcaugcacuaugcgcgaaggcacggg

SEQ ID NO: 15398 - RNA, 36 nt, Artificial Sequence
  Description of Artificial Sequence:  Enzymatic Nucleic Acid
guuugugauggcaugcacuaugcgcgauucuugugg

SEQ ID NO: 15399 - RNA, 36 nt, Artificial Sequence
  Description of Artificial Sequence:  Enzymatic Nucleic Acid
gcuagugauggcaugcacuaugcgcggaguaucugu

SEQ ID NO: 15400 - RNA, 36 nt, Artificial Sequence
  Description of Artificial Sequence:  Enzymatic Nucleic Acid
uuaauugauggcaugcacuaugcgcgaauuuaaaug

SEQ ID NO: 15401 - RNA, 36 nt, Artificial Sequence
  Description of Artificial Sequence:  Enzymatic Nucleic Acid
agaugugauggcaugcacuaugcgcgacuccuccuu

SEQ ID NO: 15402 - RNA, 36 nt, Artificial Sequence
  Description of Artificial Sequence:  Enzymatic Nucleic Acid
acuguugauggcaugcacuaugcgcgggccaaagau

SEQ ID NO: 15403 - RNA, 36 nt, Artificial Sequence
  Description of Artificial Sequence:  Enzymatic Nucleic Acid
aguuaugauggcaugcacuaugcgcgaccacugucg

SEQ ID NO: 15404 - RNA, 36 nt, Artificial Sequence
  Description of Artificial Sequence:  Enzymatic Nucleic Acid
acacaugauggcaugcacuaugcgcgaguuacacca

SEQ ID NO: 15405 - RNA, 36 nt, Artificial Sequence
  Description of Artificial Sequence:  Enzymatic Nucleic Acid
acacaugauggcaugcacuaugcgcgacaguuacac

SEQ ID NO: 15406 - RNA, 36 nt, Artificial Sequence
  Description of Artificial Sequence:  Enzymatic Nucleic Acid
acacaugauggcaugcacuaugcgcgacacaguuac

SEQ ID NO: 15407 - RNA, 36 nt, Artificial Sequence
  Description of Artificial Sequence:  Enzymatic Nucleic Acid
acacaugauggcaugcacuaugcgcgacacacaguu

SEQ ID NO: 15408 - RNA, 36 nt, Artificial Sequence
  Description of Artificial Sequence:  Enzymatic Nucleic Acid
acacaugauggcaugcacuaugcgcgacacacacag

SEQ ID NO: 15409 - RNA, 36 nt, Artificial Sequence
  Description of Artificial Sequence:  Enzymatic Nucleic Acid
acacaugauggcaugcacuaugcgcgacacacacac

SEQ ID NO: 15410 - RNA, 36 nt, Artificial Sequence
  Description of Artificial Sequence:  Enzymatic Nucleic Acid
ccacaugauggcaugcacuaugcgcgacacacacac

SEQ ID NO: 15411 - RNA, 36 nt, Artificial Sequence
  Description of Artificial Sequence:  Enzymatic Nucleic Acid
acccaugauggcaugcacuaugcgcgacacacacac

SEQ ID NO: 15412 - RNA, 36 nt, Artificial Sequence
  Description of Artificial Sequence:  Enzymatic Nucleic Acid
acccaugauggcaugcacuaugcgcgacccacacac

SEQ ID NO: 15413 - RNA, 36 nt, Artificial Sequence
  Description of Artificial Sequence:  Enzymatic Nucleic Acid
acauaugauggcaugcacuaugcgcgacccacaccc

SEQ ID NO: 15414 - RNA, 36 nt, Artificial Sequence
  Description of Artificial Sequence:  Enzymatic Nucleic Acid
acacaugauggcaugcacuaugcgcgauacacccac

SEQ ID NO: 15415 - RNA, 36 nt, Artificial Sequence
  Description of Artificial Sequence:  Enzymatic Nucleic Acid
aaacaugauggcaugcacuaugcgcgacauacaccc

SEQ ID NO: 15416 - RNA, 36 nt, Artificial Sequence
  Description of Artificial Sequence:  Enzymatic Nucleic Acid
caaaaugauggcaugcacuaugcgcgacacauacac

SEQ ID NO: 15417 - RNA, 36 nt, Artificial Sequence
  Description of Artificial Sequence:  Enzymatic Nucleic Acid
augcaugauggcaugcacuaugcgcgaaaacacaca

SEQ ID NO: 15418 - RNA, 36 nt, Artificial Sequence
  Description of Artificial Sequence:  Enzymatic Nucleic Acid
uuaugugauggcaugcacuaugcgcgacaaaacaca

SEQ ID NO: 15419 - RNA, 36 nt, Artificial Sequence
  Description of Artificial Sequence:  Enzymatic Nucleic Acid
uguagugauggcaugcacuaugcgcgauauauucuu

SEQ ID NO: 15420 - RNA, 36 nt, Artificial Sequence
  Description of Artificial Sequence:  Enzymatic Nucleic Acid
uucauugauggcaugcacuaugcgcgaugacuagaa

SEQ ID NO: 15421 - RNA, 36 nt, Artificial Sequence
  Description of Artificial Sequence:  Enzymatic Nucleic Acid
acauuugauggcaugcacuaugcgcgaucaugacua

SEQ ID NO: 15422 - RNA, 36 nt, Artificial Sequence
  Description of Artificial Sequence:  Enzymatic Nucleic Acid
aaauaugauggcaugcacuaugcgcgauucaucaug

SEQ ID NO: 15423 - RNA, 36 nt, Artificial Sequence
  Description of Artificial Sequence:  Enzymatic Nucleic Acid
guauaugauggcaugcacuaugcgcgaaaauacauu

SEQ ID NO: 15424 - RNA, 36 nt, Artificial Sequence
  Description of Artificial Sequence:  Enzymatic Nucleic Acid
gauuaugauggcaugcacuaugcgcgaaaucccaau

SEQ ID NO: 15425 - RNA, 36 nt, Artificial Sequence
  Description of Artificial Sequence:  Enzymatic Nucleic Acid
uuuauugauggcaugcacuaugcgcgaauuaaguug

SEQ ID NO: 15426 - RNA, 36 nt, Artificial Sequence
  Description of Artificial Sequence:  Enzymatic Nucleic Acid
aaaagugauggcaugcacuaugcgcgaguugccaag

SEQ ID NO: 15427 - RNA, 36 nt, Artificial Sequence
  Description of Artificial Sequence:  Enzymatic Nucleic Acid
cagaaugauggcaugcacuaugcgcgauaaaagcag

SEQ ID NO: 15428 - RNA, 36 nt, Artificial Sequence
  Description of Artificial Sequence:  Enzymatic Nucleic Acid
ggagaugauggcaugcacuaugcgcgagaacauaaa

SEQ ID NO: 15429 - RNA, 36 nt, Artificial Sequence
  Description of Artificial Sequence:  Enzymatic Nucleic Acid
cuaaaugauggcaugcacuaugcgcgaaggauaaau

SEQ ID NO: 15430 - RNA, 36 nt, Artificial Sequence
  Description of Artificial Sequence:  Enzymatic Nucleic Acid
cauuuugauggcaugcacuaugcgcgaaaguuuuuc

SEQ ID NO: 15431 - RNA, 36 nt, Artificial Sequence
  Description of Artificial Sequence:  Enzymatic Nucleic Acid
uuuagugauggcaugcacuaugcgcgaauuuuuuga

SEQ ID NO: 15432 - RNA, 36 nt, Artificial Sequence
  Description of Artificial Sequence:  Enzymatic Nucleic Acid
acuaaugauggcaugcacuaugcgcgauuuaguuuu

SEQ ID NO: 15433 - RNA, 36 nt, Artificial Sequence
  Description of Artificial Sequence:  Enzymatic Nucleic Acid
acaauugauggcaugcacuaugcgcgagcuaaacua

SEQ ID NO: 15434 - RNA, 36 nt, Artificial Sequence
  Description of Artificial Sequence:  Enzymatic Nucleic Acid
ccauaugauggcaugcacuaugcgcgaaucagcuaa

SEQ ID NO: 15435 - RNA, 36 nt, Artificial Sequence
  Description of Artificial Sequence:  Enzymatic Nucleic Acid
agguuugauggcaugcacuaugcgcggaaaacccca

SEQ ID NO: 15436 - RNA, 36 nt, Artificial Sequence
  Description of Artificial Sequence:  Enzymatic Nucleic Acid
acaaaugauggcaugcacuaugcgcgaaaaagugaa

SEQ ID NO: 15437 - RNA, 36 nt, Artificial Sequence
  Description of Artificial Sequence:  Enzymatic Nucleic Acid
uaaaaugauggcaugcacuaugcgcgaaacaaaaag

SEQ ID NO: 15438 - RNA, 36 nt, Artificial Sequence
  Description of Artificial Sequence:  Enzymatic Nucleic Acid
uuacaugauggcaugcacuaugcgcgaguugugaaa

SEQ ID NO: 15439 - RNA, 36 nt, Artificial Sequence
  Description of Artificial Sequence:  Enzymatic Nucleic Acid
auuuaugauggcaugcacuaugcgcgacaguuguga

SEQ ID NO: 15440 - RNA, 36 nt, Artificial Sequence
  Description of Artificial Sequence:  Enzymatic Nucleic Acid
auuggugauggcaugcacuaugcgcgaauuuacaca

SEQ ID NO: 15441 - RNA, 36 nt, Artificial Sequence
  Description of Artificial Sequence:  Enzymatic Nucleic Acid
auggaugauggcaugcacuaugcgcgaggaauuauu

SEQ ID NO: 15442 - RNA, 36 nt, Artificial Sequence
  Description of Artificial Sequence:  Enzymatic Nucleic Acid
auuuuugauggcaugcacuaugcgcgauggacagga

SEQ ID NO: 15443 - RNA, 36 nt, Artificial Sequence
  Description of Artificial Sequence:  Enzymatic Nucleic Acid
auuugugauggcaugcacuaugcgcgauuuucaugg

SEQ ID NO: 15444 - RNA, 36 nt, Artificial Sequence
  Description of Artificial Sequence:  Enzymatic Nucleic Acid
aucuaugauggcaugcacuaugcgcgacuggauaau

SEQ ID NO: 15445 - RNA, 36 nt, Artificial Sequence
  Description of Artificial Sequence:  Enzymatic Nucleic Acid
augguugauggcaugcacuaugcgcgaaauauaucu

SEQ ID NO: 15446 - RNA, 36 nt, Artificial Sequence
  Description of Artificial Sequence:  Enzymatic Nucleic Acid
aaaggugauggcaugcacuaugcgcgaaaacuagcc

SEQ ID NO: 15447 - RNA, 36 nt, Artificial Sequence
  Description of Artificial Sequence:  Enzymatic Nucleic Acid
acauuugauggcaugcacuaugcgcgaggcugaaau

SEQ ID NO: 15448 - RNA, 36 nt, Artificial Sequence
  Description of Artificial Sequence:  Enzymatic Nucleic Acid
gcagaugauggcaugcacuaugcgcgauucaggcug

SEQ ID NO: 15449 - RNA, 36 nt, Artificial Sequence
  Description of Artificial Sequence:  Enzymatic Nucleic Acid
auaggugauggcaugcacuaugcgcgagacauucag

SEQ ID NO: 15450 - RNA, 36 nt, Artificial Sequence
  Description of Artificial Sequence:  Enzymatic Nucleic Acid
aagagugauggcaugcacuaugcgcgagagaauaua

SEQ ID NO: 15451 - RNA, 36 nt, Artificial Sequence
  Description of Artificial Sequence:  Enzymatic Nucleic Acid
gaauaugauggcaugcacuaugcgcgaaagagcaga

SEQ ID NO: 15452 - RNA, 36 nt, Artificial Sequence
  Description of Artificial Sequence:  Enzymatic Nucleic Acid
ggguuugauggcaugcacuaugcgcgaaaggagaau

SEQ ID NO: 15453 - RNA, 36 nt, Artificial Sequence
  Description of Artificial Sequence:  Enzymatic Nucleic Acid
ugccaugauggcaugcacuaugcgcgaggauguuuu

SEQ ID NO: 15454 - RNA, 38 nt, Artificial Sequence
  Description of Artificial Sequence:  Enzymatic Nucleic Acid
  misc_feature (31)..(31): n stands for inosine
cggccagccugaugaggccguuaggccgaancaccuug

SEQ ID NO: 15455 - RNA, 38 nt, Artificial Sequence
  Description of Artificial Sequence:  Enzymatic Nucleic Acid
  misc_feature (31)..(31): n stands for inosine
cgacggcccugaugaggccguuaggccgaancagcacc

SEQ ID NO: 15456 - RNA, 38 nt, Artificial Sequence
  Description of Artificial Sequence:  Enzymatic Nucleic Acid
  misc_feature (31)..(31): n stands for inosine
agggcgaccugaugaggccguuaggccgaanccagcag

SEQ ID NO: 15457 - RNA, 38 nt, Artificial Sequence
  Description of Artificial Sequence:  Enzymatic Nucleic Acid
  misc_feature (31)..(31): n stands for inosine
agccacagcugaugaggccguuaggccgaancgacggc

SEQ ID NO: 15458 - RNA, 38 nt, Artificial Sequence
  Description of Artificial Sequence:  Enzymatic Nucleic Acid
  misc_feature (31)..(31): n stands for inosine
gagccacacugaugaggccguuaggccgaangcgacgg

SEQ ID NO: 15459 - RNA, 38 nt, Artificial Sequence
  Description of Artificial Sequence:  Enzymatic Nucleic Acid
  misc_feature (31)..(31): n stands for inosine
agagccaccugaugaggccguuaggccgaanggcgacg

SEQ ID NO: 15460 - RNA, 38 nt, Artificial Sequence
  Description of Artificial Sequence:  Enzymatic Nucleic Acid
  misc_feature (31)..(31): n stands for inosine
ccacgcagcugaugaggccguuaggccgaanccacagg

SEQ ID NO: 15461 - RNA, 38 nt, Artificial Sequence
  Description of Artificial Sequence:  Enzymatic Nucleic Acid
  misc_feature (31)..(31): n stands for inosine
cuccacgccugaugaggccguuaggccgaanagccaca

SEQ ID NO: 15462 - RNA, 38 nt, Artificial Sequence
  Description of Artificial Sequence:  Enzymatic Nucleic Acid
  misc_feature (31)..(31): n stands for inosine
gcggcccgcugaugaggccguuaggccgaanucuccac

SEQ ID NO: 15463 - RNA, 38 nt, Artificial Sequence
  Description of Artificial Sequence:  Enzymatic Nucleic Acid
  misc_feature (31)..(31): n stands for inosine
ggcggccccugaugaggccguuaggccgaangucucca

SEQ ID NO: 15464 - RNA, 38 nt, Artificial Sequence
  Description of Artificial Sequence:  Enzymatic Nucleic Acid
  misc_feature (31)..(31): n stands for inosine
acagaggccugaugaggccguuaggccgaancccgggu

SEQ ID NO: 15465 - RNA, 38 nt, Artificial Sequence
  Description of Artificial Sequence:  Enzymatic Nucleic Acid
  misc_feature (31)..(31): n stands for inosine
cccacagacugaugaggccguuaggccgaancggcccg

SEQ ID NO: 15466 - RNA, 38 nt, Artificial Sequence
  Description of Artificial Sequence:  Enzymatic Nucleic Acid
  misc_feature (31)..(31): n stands for inosine
acccacagcugaugaggccguuaggccgaangcggccc

SEQ ID NO: 15467 - RNA, 38 nt, Artificial Sequence
  Description of Artificial Sequence:  Enzymatic Nucleic Acid
  misc_feature (31)..(31): n stands for inosine
aaacccaccugaugaggccguuaggccgaanaggcggc

SEQ ID NO: 15468 - RNA, 38 nt, Artificial Sequence
  Description of Artificial Sequence:  Enzymatic Nucleic Acid
  misc_feature (31)..(31): n stands for inosine
aaacacuacugaugaggccguuaggccgaancaaaccc

SEQ ID NO: 15469 - RNA, 38 nt, Artificial Sequence
  Description of Artificial Sequence:  Enzymatic Nucleic Acid
  misc_feature (31)..(31): n stands for inosine
gaaacacucugaugaggccguuaggccgaangcaaacc

SEQ ID NO: 15470 - RNA, 38 nt, Artificial Sequence
  Description of Artificial Sequence:  Enzymatic Nucleic Acid
  misc_feature (31)..(31): n stands for inosine
agaucaagcugaugaggccguuaggccgaanaaacacu

SEQ ID NO: 15471 - RNA, 38 nt, Artificial Sequence
  Description of Artificial Sequence:  Enzymatic Nucleic Acid
  misc_feature (31)..(31): n stands for inosine
gcagaucacugaugaggccguuaggccgaanagaaaca

SEQ ID NO: 15472 - RNA, 38 nt, Artificial Sequence
  Description of Artificial Sequence:  Enzymatic Nucleic Acid
  misc_feature (31)..(31): n stands for inosine
gccugggccugaugaggccguuaggccgaanaucaaga

SEQ ID NO: 15473 - RNA, 38 nt, Artificial Sequence
  Description of Artificial Sequence:  Enzymatic Nucleic Acid
  misc_feature (31)..(31): n stands for inosine
ugagccugcugaugaggccguuaggccgaancagauca

SEQ ID NO: 15474 - RNA, 38 nt, Artificial Sequence
  Description of Artificial Sequence:  Enzymatic Nucleic Acid
  misc_feature (31)..(31): n stands for inosine
cugagccucugaugaggccguuaggccgaangcagauc

SEQ ID NO: 15475 - RNA, 38 nt, Artificial Sequence
  Description of Artificial Sequence:  Enzymatic Nucleic Acid
  misc_feature (31)..(31): n stands for inosine
gcugagcccugaugaggccguuaggccgaanggcagau

SEQ ID NO: 15476 - RNA, 38 nt, Artificial Sequence
  Description of Artificial Sequence:  Enzymatic Nucleic Acid
  misc_feature (31)..(31): n stands for inosine
guaugcugcugaugaggccguuaggccgaanccugggc

SEQ ID NO: 15477 - RNA, 38 nt, Artificial Sequence
  Description of Artificial Sequence:  Enzymatic Nucleic Acid
  misc_feature (31)..(31): n stands for inosine
uuguaugccugaugaggccguuaggccgaanagccugg

SEQ ID NO: 15478 - RNA, 38 nt, Artificial Sequence
  Description of Artificial Sequence:  Enzymatic Nucleic Acid
  misc_feature (31)..(31): n stands for inosine
uuuuuguacugaugaggccguuaggccgaancugagcc

SEQ ID NO: 15479 - RNA, 38 nt, Artificial Sequence
  Description of Artificial Sequence:  Enzymatic Nucleic Acid
  misc_feature (31)..(31): n stands for inosine
ugucuuuucugaugaggccguuaggccgaanuaugcug

SEQ ID NO: 15480 - RNA, 38 nt, Artificial Sequence
  Description of Artificial Sequence:  Enzymatic Nucleic Acid
  misc_feature (31)..(31): n stands for inosine
uguaaguacugaugaggccguuaggccgaanucuuuuu

SEQ ID NO: 15481 - RNA, 38 nt, Artificial Sequence
  Description of Artificial Sequence:  Enzymatic Nucleic Acid
  misc_feature (31)..(31): n stands for inosine
uaauuguacugaugaggccguuaggccgaanuaugucu

SEQ ID NO: 15482 - RNA, 38 nt, Artificial Sequence
  Description of Artificial Sequence:  Enzymatic Nucleic Acid
  misc_feature (31)..(31): n stands for inosine
gccuuaaucugaugaggccguuaggccgaanuaaguau

SEQ ID NO: 15483 - RNA, 38 nt, Artificial Sequence
  Description of Artificial Sequence:  Enzymatic Nucleic Acid
  misc_feature (31)..(31): n stands for inosine
guuguauucugaugaggccguuaggccgaanccuuaau

SEQ ID NO: 15484 - RNA, 38 nt, Artificial Sequence
  Description of Artificial Sequence:  Enzymatic Nucleic Acid
  misc_feature (31)..(31): n stands for inosine
ugaagagucugaugaggccguuaggccgaanuauuagc

SEQ ID NO: 15485 - RNA, 38 nt, Artificial Sequence
  Description of Artificial Sequence:  Enzymatic Nucleic Acid
  misc_feature (31)..(31): n stands for inosine
auuugaagcugaugaggccguuaggccgaanuuguauu

SEQ ID NO: 15486 - RNA, 38 nt, Artificial Sequence
  Description of Artificial Sequence:  Enzymatic Nucleic Acid
  misc_feature (31)..(31): n stands for inosine
uaauuugacugaugaggccguuaggccgaanaguugua

SEQ ID NO: 15487 - RNA, 38 nt, Artificial Sequence
  Description of Artificial Sequence:  Enzymatic Nucleic Acid
  misc_feature (31)..(31): n stands for inosine
aaguaauucugaugaggccguuaggccgaanaagaguu

SEQ ID NO: 15488 - RNA, 38 nt, Artificial Sequence
  Description of Artificial Sequence:  Enzymatic Nucleic Acid
  misc_feature (31)..(31): n stands for inosine
ccccugcacugaugaggccguuaggccgaanuaauuug

SEQ ID NO: 15489 - RNA, 38 nt, Artificial Sequence
  Description of Artificial Sequence:  Enzymatic Nucleic Acid
  misc_feature (31)..(31): n stands for inosine
cugucccccugaugaggccguuaggccgaancaaguaa

SEQ ID NO: 15490 - RNA, 38 nt, Artificial Sequence
  Description of Artificial Sequence:  Enzymatic Nucleic Acid
  misc_feature (31)..(31): n stands for inosine
agucccuccugaugaggccguuaggccgaanuccccug

SEQ ID NO: 15491 - RNA, 38 nt, Artificial Sequence
  Description of Artificial Sequence:  Enzymatic Nucleic Acid
  misc_feature (31)..(31): n stands for inosine
ccaguccacugaugaggccguuaggccgaanucccucu

SEQ ID NO: 15492 - RNA, 38 nt, Artificial Sequence
  Description of Artificial Sequence:  Enzymatic Nucleic Acid
  misc_feature (31)..(31): n stands for inosine
ccaaagcccugaugaggccguuaggccgaanuccaagu

SEQ ID NO: 15493 - RNA, 38 nt, Artificial Sequence
  Description of Artificial Sequence:  Enzymatic Nucleic Acid
  misc_feature (31)..(31): n stands for inosine
ugggccaacugaugaggccguuaggccgaanccagucc

SEQ ID NO: 15494 - RNA, 38 nt, Artificial Sequence
  Description of Artificial Sequence:  Enzymatic Nucleic Acid
  misc_feature (31)..(31): n stands for inosine
gauuauugcugaugaggccguuaggccgaanccaaagc

SEQ ID NO: 15495 - RNA, 38 nt, Artificial Sequence
  Description of Artificial Sequence:  Enzymatic Nucleic Acid
  misc_feature (31)..(31): n stands for inosine
ugauuauucugaugaggccguuaggccgaangccaaag

SEQ ID NO: 15496 - RNA, 38 nt, Artificial Sequence
  Description of Artificial Sequence:  Enzymatic Nucleic Acid
  misc_feature (31)..(31): n stands for inosine
cugauuaucugaugaggccguuaggccgaanggccaaa

SEQ ID NO: 15497 - RNA, 38 nt, Artificial Sequence
  Description of Artificial Sequence:  Enzymatic Nucleic Acid
  misc_feature (31)..(31): n stands for inosine
ugccacuccugaugaggccguuaggccgaanauuauug

SEQ ID NO: 15498 - RNA, 38 nt, Artificial Sequence
  Description of Artificial Sequence:  Enzymatic Nucleic Acid
  misc_feature (31)..(31): n stands for inosine
uugcucaccugaugaggccguuaggccgaanccacucu

SEQ ID NO: 15499 - RNA, 38 nt, Artificial Sequence
  Description of Artificial Sequence:  Enzymatic Nucleic Acid
  misc_feature (31)..(31): n stands for inosine
ccacccuucugaugaggccguuaggccgaancucacug

SEQ ID NO: 15500 - RNA, 38 nt, Artificial Sequence
  Description of Artificial Sequence:  Enzymatic Nucleic Acid
  misc_feature (31)..(31): n stands for inosine
cugcacuccugaugaggccguuaggccgaanucaccuc

SEQ ID NO: 15501 - RNA, 38 nt, Artificial Sequence
  Description of Artificial Sequence:  Enzymatic Nucleic Acid
  misc_feature (31)..(31): n stands for inosine
gccaucgccugaugaggccguuaggccgaancacucag

SEQ ID NO: 15502 - RNA, 38 nt, Artificial Sequence
  Description of Artificial Sequence:  Enzymatic Nucleic Acid
  misc_feature (31)..(31): n stands for inosine
acagaagacugaugaggccguuaggccgaanccaucgc

SEQ ID NO: 15503 - RNA, 38 nt, Artificial Sequence
  Description of Artificial Sequence:  Enzymatic Nucleic Acid
  misc_feature (31)..(31): n stands for inosine
uacagaagcugaugaggccguuaggccgaangccaucg

SEQ ID NO: 15504 - RNA, 38 nt, Artificial Sequence
  Description of Artificial Sequence:  Enzymatic Nucleic Acid
  misc_feature (31)..(31): n stands for inosine
cuuacagacugaugaggccguuaggccgaanaggccau

SEQ ID NO: 15505 - RNA, 38 nt, Artificial Sequence
  Description of Artificial Sequence:  Enzymatic Nucleic Acid
  misc_feature (31)..(31): n stands for inosine
ugucuuaccugaugaggccguuaggccgaanaagaggc

SEQ ID NO: 15506 - RNA, 38 nt, Artificial Sequence
  Description of Artificial Sequence:  Enzymatic Nucleic Acid
  misc_feature (31)..(31): n stands for inosine
auugugagcugaugaggccguuaggccgaanucuuaca

SEQ ID NO: 15507 - RNA, 38 nt, Artificial Sequence
  Description of Artificial Sequence:  Enzymatic Nucleic Acid
  misc_feature (31)..(31): n stands for inosine
gaauugugcugaugaggccguuaggccgaanugucuua

SEQ ID NO: 15508 - RNA, 38 nt, Artificial Sequence
  Description of Artificial Sequence:  Enzymatic Nucleic Acid
  misc_feature (31)..(31): n stands for inosine
uggaauugcugaugaggccguuaggccgaanagugucu

SEQ ID NO: 15509 - RNA, 38 nt, Artificial Sequence
  Description of Artificial Sequence:  Enzymatic Nucleic Acid
  misc_feature (31)..(31): n stands for inosine
uuuggaaucugaugaggccguuaggccgaanugagugu

SEQ ID NO: 15510 - RNA, 38 nt, Artificial Sequence
  Description of Artificial Sequence:  Enzymatic Nucleic Acid
  misc_feature (31)..(31): n stands for inosine
ucacuuuucugaugaggccguuaggccgaanaauugug

SEQ ID NO: 15511 - RNA, 38 nt, Artificial Sequence
  Description of Artificial Sequence:  Enzymatic Nucleic Acid
  misc_feature (31)..(31): n stands for inosine
aucacuuucugaugaggccguuaggccgaangaauugu

SEQ ID NO: 15512 - RNA, 38 nt, Artificial Sequence
  Description of Artificial Sequence:  Enzymatic Nucleic Acid
  misc_feature (31)..(31): n stands for inosine
ggcuccagcugaugaggccguuaggccgaanucauuuc

SEQ ID NO: 15513 - RNA, 38 nt, Artificial Sequence
  Description of Artificial Sequence:  Enzymatic Nucleic Acid
  misc_feature (31)..(31): n stands for inosine
uaggcucccugaugaggccguuaggccgaanugucauu

SEQ ID NO: 15514 - RNA, 38 nt, Artificial Sequence
  Description of Artificial Sequence:  Enzymatic Nucleic Acid
  misc_feature (31)..(31): n stands for inosine
cacuuguacugaugaggccguuaggccgaancuccagu

SEQ ID NO: 15515 - RNA, 38 nt, Artificial Sequence
  Description of Artificial Sequence:  Enzymatic Nucleic Acid
  misc_feature (31)..(31): n stands for inosine
gcacuugucugaugaggccguuaggccgaangcuccag

SEQ ID NO: 15516 - RNA, 38 nt, Artificial Sequence
  Description of Artificial Sequence:  Enzymatic Nucleic Acid
  misc_feature (31)..(31): n stands for inosine
gaagcacucugaugaggccguuaggccgaanuaggcuc

SEQ ID NO: 15517 - RNA, 38 nt, Artificial Sequence
  Description of Artificial Sequence:  Enzymatic Nucleic Acid
  misc_feature (31)..(31): n stands for inosine
ccgguagacugaugaggccguuaggccgaancacuugu

SEQ ID NO: 15518 - RNA, 38 nt, Artificial Sequence
  Description of Artificial Sequence:  Enzymatic Nucleic Acid
  misc_feature (31)..(31): n stands for inosine
uucccggucugaugaggccguuaggccgaanaagcacu

SEQ ID NO: 15519 - RNA, 38 nt, Artificial Sequence
  Description of Artificial Sequence:  Enzymatic Nucleic Acid
  misc_feature (31)..(31): n stands for inosine
aguuuccccugaugaggccguuaggccgaanuagaagc

SEQ ID NO: 15520 - RNA, 38 nt, Artificial Sequence
  Description of Artificial Sequence:  Enzymatic Nucleic Acid
  misc_feature (31)..(31): n stands for inosine
gccaaguccugaugaggccguuaggccgaanuuucccg

SEQ ID NO: 15521 - RNA, 38 nt, Artificial Sequence
  Description of Artificial Sequence:  Enzymatic Nucleic Acid
  misc_feature (31)..(31): n stands for inosine
cgaggccacugaugaggccguuaggccgaanucaguuu

SEQ ID NO: 15522 - RNA, 38 nt, Artificial Sequence
  Description of Artificial Sequence:  Enzymatic Nucleic Acid
  misc_feature (31)..(31): n stands for inosine
augaccgacugaugaggccguuaggccgaanccaaguc

SEQ ID NO: 15523 - RNA, 38 nt, Artificial Sequence
  Description of Artificial Sequence:  Enzymatic Nucleic Acid
  misc_feature (31)..(31): n stands for inosine
aaugaccgcugaugaggccguuaggccgaangccaagu

SEQ ID NO: 15524 - RNA, 38 nt, Artificial Sequence
  Description of Artificial Sequence:  Enzymatic Nucleic Acid
  misc_feature (31)..(31): n stands for inosine
gacauaaacugaugaggccguuaggccgaanaccgagg

SEQ ID NO: 15525 - RNA, 38 nt, Artificial Sequence
  Description of Artificial Sequence:  Enzymatic Nucleic Acid
  misc_feature (31)..(31): n stands for inosine
uugaacaucugaugaggccguuaggccgaanacauaaa

SEQ ID NO: 15526 - RNA, 38 nt, Artificial Sequence
  Description of Artificial Sequence:  Enzymatic Nucleic Acid
  misc_feature (31)..(31): n stands for inosine
uguaaucucugaugaggccguuaggccgaanaacauag

SEQ ID NO: 15527 - RNA, 38 nt, Artificial Sequence
  Description of Artificial Sequence:  Enzymatic Nucleic Acid
  misc_feature (31)..(31): n stands for inosine
uggagauccugaugaggccguuaggccgaanuaaucuu

SEQ ID NO: 15528 - RNA, 38 nt, Artificial Sequence
  Description of Artificial Sequence:  Enzymatic Nucleic Acid
  misc_feature (31)..(31): n stands for inosine
auaaauggcugaugaggccguuaggccgaanaucugua

SEQ ID NO: 15529 - RNA, 38 nt, Artificial Sequence
  Description of Artificial Sequence:  Enzymatic Nucleic Acid
  misc_feature (31)..(31): n stands for inosine
caauaaaucugaugaggccguuaggccgaanagaucug

SEQ ID NO: 15530 - RNA, 38 nt, Artificial Sequence
  Description of Artificial Sequence:  Enzymatic Nucleic Acid
  misc_feature (31)..(31): n stands for inosine
gcaauaaacugaugaggccguuaggccgaangagaucu

SEQ ID NO: 15531 - RNA, 38 nt, Artificial Sequence
  Description of Artificial Sequence:  Enzymatic Nucleic Acid
  misc_feature (31)..(31): n stands for inosine
cuaacagacugaugaggccguuaggccgaancaauaaa

SEQ ID NO: 15532 - RNA, 38 nt, Artificial Sequence
  Description of Artificial Sequence:  Enzymatic Nucleic Acid
  misc_feature (31)..(31): n stands for inosine
ucacuaaccugaugaggccguuaggccgaanaagcaau

SEQ ID NO: 15533 - RNA, 38 nt, Artificial Sequence
  Description of Artificial Sequence:  Enzymatic Nucleic Acid
  misc_feature (31)..(31): n stands for inosine
uccauguucugaugaggccguuaggccgaanucacuaa

SEQ ID NO: 15534 - RNA, 38 nt, Artificial Sequence
  Description of Artificial Sequence:  Enzymatic Nucleic Acid
  misc_feature (31)..(31): n stands for inosine
cuccaugucugaugaggccguuaggccgaangucacua

SEQ ID NO: 15535 - RNA, 38 nt, Artificial Sequence
  Description of Artificial Sequence:  Enzymatic Nucleic Acid
  misc_feature (31)..(31): n stands for inosine
cgacuccacugaugaggccguuaggccgaanuugguca

SEQ ID NO: 15536 - RNA, 38 nt, Artificial Sequence
  Description of Artificial Sequence:  Enzymatic Nucleic Acid
  misc_feature (31)..(31): n stands for inosine
cucaguaacugaugaggccguuaggccgaanuacacga

SEQ ID NO: 15537 - RNA, 38 nt, Artificial Sequence
  Description of Artificial Sequence:  Enzymatic Nucleic Acid
  misc_feature (31)..(31): n stands for inosine
uuguucuccugaugaggccguuaggccgaanuaaugua

SEQ ID NO: 15538 - RNA, 38 nt, Artificial Sequence
  Description of Artificial Sequence:  Enzymatic Nucleic Acid
  misc_feature (31)..(31): n stands for inosine
uuuguuuucugaugaggccguuaggccgaanuucucag

SEQ ID NO: 15539 - RNA, 38 nt, Artificial Sequence
  Description of Artificial Sequence:  Enzymatic Nucleic Acid
  misc_feature (31)..(31): n stands for inosine
cacaguuucugaugaggccguuaggccgaanuuuuugu

SEQ ID NO: 15540 - RNA, 38 nt, Artificial Sequence
  Description of Artificial Sequence:  Enzymatic Nucleic Acid
  misc_feature (31)..(31): n stands for inosine
aucaccaccugaugaggccguuaggccgaanuuuuguu

SEQ ID NO: 15541 - RNA, 38 nt, Artificial Sequence
  Description of Artificial Sequence:  Enzymatic Nucleic Acid
  misc_feature (31)..(31): n stands for inosine
cgagacaucugaugaggccguuaggccgaanaaucacc

SEQ ID NO: 15542 - RNA, 38 nt, Artificial Sequence
  Description of Artificial Sequence:  Enzymatic Nucleic Acid
  misc_feature (31)..(31): n stands for inosine
ccgagacacugaugaggccguuaggccgaangaaucac

SEQ ID NO: 15543 - RNA, 38 nt, Artificial Sequence
  Description of Artificial Sequence:  Enzymatic Nucleic Acid
  misc_feature (31)..(31): n stands for inosine
uggacccgcugaugaggccguuaggccgaanacaugga

SEQ ID NO: 15544 - RNA, 38 nt, Artificial Sequence
  Description of Artificial Sequence:  Enzymatic Nucleic Acid
  misc_feature (31)..(31): n stands for inosine
uuugaaaucugaugaggccguuaggccgaanacccgag

SEQ ID NO: 15545 - RNA, 38 nt, Artificial Sequence
  Description of Artificial Sequence:  Enzymatic Nucleic Acid
  misc_feature (31)..(31): n stands for inosine
auuugaaacugaugaggccguuaggccgaangacccga

SEQ ID NO: 15546 - RNA, 38 nt, Artificial Sequence
  Description of Artificial Sequence:  Enzymatic Nucleic Acid
  misc_feature (31)..(31): n stands for inosine
uugagauucugaugaggccguuaggccgaanaaaugga

SEQ ID NO: 15547 - RNA, 38 nt, Artificial Sequence
  Description of Artificial Sequence:  Enzymatic Nucleic Acid
  misc_feature (31)..(31): n stands for inosine
acacguugcugaugaggccguuaggccgaanauuugaa

SEQ ID NO: 15548 - RNA, 38 nt, Artificial Sequence
  Description of Artificial Sequence:  Enzymatic Nucleic Acid
  misc_feature (31)..(31): n stands for inosine
ugacacgucugaugaggccguuaggccgaanagauuug

SEQ ID NO: 15549 - RNA, 38 nt, Artificial Sequence
  Description of Artificial Sequence:  Enzymatic Nucleic Acid
  misc_feature (31)..(31): n stands for inosine
gcacaaagcugaugaggccguuaggccgaanacacguu

SEQ ID NO: 15550 - RNA, 38 nt, Artificial Sequence
  Description of Artificial Sequence:  Enzymatic Nucleic Acid
  misc_feature (31)..(31): n stands for inosine
uugcacaacugaugaggccguuaggccgaanugacacg

SEQ ID NO: 15551 - RNA, 38 nt, Artificial Sequence
  Description of Artificial Sequence:  Enzymatic Nucleic Acid
  misc_feature (31)..(31): n stands for inosine
ggguaucucugaugaggccguuaggccgaancacaaag

SEQ ID NO: 15552 - RNA, 38 nt, Artificial Sequence
  Description of Artificial Sequence:  Enzymatic Nucleic Acid
  misc_feature (31)..(31): n stands for inosine
cuuuucugcugaugaggccguuaggccgaanuaucuug

SEQ ID NO: 15553 - RNA, 38 nt, Artificial Sequence
  Description of Artificial Sequence:  Enzymatic Nucleic Acid
  misc_feature (31)..(31): n stands for inosine
ucuuuucucugaugaggccguuaggccgaanguaucuu

SEQ ID NO: 15554 - RNA, 38 nt, Artificial Sequence
  Description of Artificial Sequence:  Enzymatic Nucleic Acid
  misc_feature (31)..(31): n stands for inosine
cucuuuuccugaugaggccguuaggccgaangguaucu

SEQ ID NO: 15555 - RNA, 38 nt, Artificial Sequence
  Description of Artificial Sequence:  Enzymatic Nucleic Acid
  misc_feature (31)..(31): n stands for inosine
uaccaucacugaugaggccguuaggccgaanaacaaau

SEQ ID NO: 15556 - RNA, 38 nt, Artificial Sequence
  Description of Artificial Sequence:  Enzymatic Nucleic Acid
  misc_feature (31)..(31): n stands for inosine
uuaccauccugaugaggccguuaggccgaangaacaaa

SEQ ID NO: 15557 - RNA, 38 nt, Artificial Sequence
  Description of Artificial Sequence:  Enzymatic Nucleic Acid
  misc_feature (31)..(31): n stands for inosine
ggaaauuccugaugaggccguuaggccgaanuuaccau

SEQ ID NO: 15558 - RNA, 38 nt, Artificial Sequence
  Description of Artificial Sequence:  Enzymatic Nucleic Acid
  misc_feature (31)..(31): n stands for inosine
cugucccacugaugaggccguuaggccgaanaaauucu

SEQ ID NO: 15559 - RNA, 38 nt, Artificial Sequence
  Description of Artificial Sequence:  Enzymatic Nucleic Acid
  misc_feature (31)..(31): n stands for inosine
gcuguccccugaugaggccguuaggccgaangaaauuc

SEQ ID NO: 15560 - RNA, 38 nt, Artificial Sequence
  Description of Artificial Sequence:  Enzymatic Nucleic Acid
  misc_feature (31)..(31): n stands for inosine
cuucuugccugaugaggccguuaggccgaanucccagg

SEQ ID NO: 15561 - RNA, 38 nt, Artificial Sequence
  Description of Artificial Sequence:  Enzymatic Nucleic Acid
  misc_feature (31)..(31): n stands for inosine
gcccuucucugaugaggccguuaggccgaancuguccc

SEQ ID NO: 15562 - RNA, 38 nt, Artificial Sequence
  Description of Artificial Sequence:  Enzymatic Nucleic Acid
  misc_feature (31)..(31): n stands for inosine
aauaguaacugaugaggccguuaggccgaancccuucu

SEQ ID NO: 15563 - RNA, 38 nt, Artificial Sequence
  Description of Artificial Sequence:  Enzymatic Nucleic Acid
  misc_feature (31)..(31): n stands for inosine
cugggaaucugaugaggccguuaggccgaanuaaagcc

SEQ ID NO: 15564 - RNA, 38 nt, Artificial Sequence
  Description of Artificial Sequence:  Enzymatic Nucleic Acid
  misc_feature (31)..(31): n stands for inosine
uguagcugcugaugaggccguuaggccgaanaauagua

SEQ ID NO: 15565 - RNA, 38 nt, Artificial Sequence
  Description of Artificial Sequence:  Enzymatic Nucleic Acid
  misc_feature (31)..(31): n stands for inosine
auguagcucugaugaggccguuaggccgaangaauagu

SEQ ID NO: 15566 - RNA, 38 nt, Artificial Sequence
  Description of Artificial Sequence:  Enzymatic Nucleic Acid
  misc_feature (31)..(31): n stands for inosine
cauguagccugaugaggccguuaggccgaanggaauag

SEQ ID NO: 15567 - RNA, 38 nt, Artificial Sequence
  Description of Artificial Sequence:  Enzymatic Nucleic Acid
  misc_feature (31)..(31): n stands for inosine
gaucaugucugaugaggccguuaggccgaancugggaa

SEQ ID NO: 15568 - RNA, 38 nt, Artificial Sequence
  Description of Artificial Sequence:  Enzymatic Nucleic Acid
  misc_feature (31)..(31): n stands for inosine
gcugaucacugaugaggccguuaggccgaanuagcugg

SEQ ID NO: 15569 - RNA, 38 nt, Artificial Sequence
  Description of Artificial Sequence:  Enzymatic Nucleic Acid
  misc_feature (31)..(31): n stands for inosine
agcauagccugaugaggccguuaggccgaanaucaugu

SEQ ID NO: 15570 - RNA, 38 nt, Artificial Sequence
  Description of Artificial Sequence:  Enzymatic Nucleic Acid
  misc_feature (31)..(31): n stands for inosine
gccagcaucugaugaggccguuaggccgaancugauca

SEQ ID NO: 15571 - RNA, 38 nt, Artificial Sequence
  Description of Artificial Sequence:  Enzymatic Nucleic Acid
  misc_feature (31)..(31): n stands for inosine
accaugcccugaugaggccguuaggccgaancauagcu

SEQ ID NO: 15572 - RNA, 38 nt, Artificial Sequence
  Description of Artificial Sequence:  Enzymatic Nucleic Acid
  misc_feature (31)..(31): n stands for inosine
gaagaccacugaugaggccguuaggccgaanccagcau

SEQ ID NO: 15573 - RNA, 38 nt, Artificial Sequence
  Description of Artificial Sequence:  Enzymatic Nucleic Acid
  misc_feature (31)..(31): n stands for inosine
uucacagacugaugaggccguuaggccgaanaccaugc

SEQ ID NO: 15574 - RNA, 38 nt, Artificial Sequence
  Description of Artificial Sequence:  Enzymatic Nucleic Acid
  misc_feature (31)..(31): n stands for inosine
ugcuucaccugaugaggccguuaggccgaanaagacca

SEQ ID NO: 15575 - RNA, 38 nt, Artificial Sequence
  Description of Artificial Sequence:  Enzymatic Nucleic Acid
  misc_feature (31)..(31): n stands for inosine
uuaauuuucugaugaggccguuaggccgaancuucaca

SEQ ID NO: 15576 - RNA, 38 nt, Artificial Sequence
  Description of Artificial Sequence:  Enzymatic Nucleic Acid
  misc_feature (31)..(31): n stands for inosine
aauagacucugaugaggccguuaggccgaanuaacuuu

SEQ ID NO: 15577 - RNA, 38 nt, Artificial Sequence
  Description of Artificial Sequence:  Enzymatic Nucleic Acid
  misc_feature (31)..(31): n stands for inosine
uaauagaccugaugaggccguuaggccgaanguaacuu

SEQ ID NO: 15578 - RNA, 38 nt, Artificial Sequence
  Description of Artificial Sequence:  Enzymatic Nucleic Acid
  misc_feature (31)..(31): n stands for inosine
uacauaaucugaugaggccguuaggccgaanacuggua

SEQ ID NO: 15579 - RNA, 38 nt, Artificial Sequence
  Description of Artificial Sequence:  Enzymatic Nucleic Acid
  misc_feature (31)..(31): n stands for inosine
gacaacuacugaugaggccguuaggccgaanuacauaa

SEQ ID NO: 15580 - RNA, 38 nt, Artificial Sequence
  Description of Artificial Sequence:  Enzymatic Nucleic Acid
  misc_feature (31)..(31): n stands for inosine
acggacuccugaugaggccguuaggccgaanaaccaca

SEQ ID NO: 15581 - RNA, 38 nt, Artificial Sequence
  Description of Artificial Sequence:  Enzymatic Nucleic Acid
  misc_feature (31)..(31): n stands for inosine
caugagaccugaugaggccguuaggccgaanacucaga

SEQ ID NO: 15582 - RNA, 38 nt, Artificial Sequence
  Description of Artificial Sequence:  Enzymatic Nucleic Acid
  misc_feature (31)..(31): n stands for inosine
auuccaugcugaugaggccguuaggccgaanacggacu

SEQ ID NO: 15583 - RNA, 38 nt, Artificial Sequence
  Description of Artificial Sequence:  Enzymatic Nucleic Acid
  misc_feature (31)..(31): n stands for inosine
caauuccacugaugaggccguuaggccgaanagacgga

SEQ ID NO: 15584 - RNA, 38 nt, Artificial Sequence
  Description of Artificial Sequence:  Enzymatic Nucleic Acid
  misc_feature (31)..(31): n stands for inosine
caacagaucugaugaggccguuaggccgaanuucaauu

SEQ ID NO: 15585 - RNA, 38 nt, Artificial Sequence
  Description of Artificial Sequence:  Enzymatic Nucleic Acid
  misc_feature (31)..(31): n stands for inosine
ucuccaaccugaugaggccguuaggccgaanauaguuc

SEQ ID NO: 15586 - RNA, 38 nt, Artificial Sequence
  Description of Artificial Sequence:  Enzymatic Nucleic Acid
  misc_feature (31)..(31): n stands for inosine
uuaagacacugaugaggccguuaggccgaancuuuucu

SEQ ID NO: 15587 - RNA, 38 nt, Artificial Sequence
  Description of Artificial Sequence:  Enzymatic Nucleic Acid
  misc_feature (31)..(31): n stands for inosine
acaauuuacugaugaggccguuaggccgaanacaagcu

SEQ ID NO: 15588 - RNA, 38 nt, Artificial Sequence
  Description of Artificial Sequence:  Enzymatic Nucleic Acid
  misc_feature (31)..(31): n stands for inosine
guucuugccugaugaggccguuaggccgaanuacaauu

SEQ ID NO: 15589 - RNA, 38 nt, Artificial Sequence
  Description of Artificial Sequence:  Enzymatic Nucleic Acid
  misc_feature (31)..(31): n stands for inosine
ucaguucucugaugaggccguuaggccgaancuguaca

SEQ ID NO: 15590 - RNA, 38 nt, Artificial Sequence
  Description of Artificial Sequence:  Enzymatic Nucleic Acid
  misc_feature (31)..(31): n stands for inosine
uuuaguuccugaugaggccguuaggccgaanuucuugc

SEQ ID NO: 15591 - RNA, 38 nt, Artificial Sequence
  Description of Artificial Sequence:  Enzymatic Nucleic Acid
  misc_feature (31)..(31): n stands for inosine
ccacauuucugaugaggccguuaggccgaanuucaguu

SEQ ID NO: 15592 - RNA, 38 nt, Artificial Sequence
  Description of Artificial Sequence:  Enzymatic Nucleic Acid
  misc_feature (31)..(31): n stands for inosine
ccaguugacugaugaggccguuaggccgaanucaaucc

SEQ ID NO: 15593 - RNA, 38 nt, Artificial Sequence
  Description of Artificial Sequence:  Enzymatic Nucleic Acid
  misc_feature (31)..(31): n stands for inosine
uucccagucugaugaggccguuaggccgaanaagucaa

SEQ ID NO: 15594 - RNA, 38 nt, Artificial Sequence
  Description of Artificial Sequence:  Enzymatic Nucleic Acid
  misc_feature (31)..(31): n stands for inosine
guauuccccugaugaggccguuaggccgaanuugaagu

SEQ ID NO: 15595 - RNA, 38 nt, Artificial Sequence
  Description of Artificial Sequence:  Enzymatic Nucleic Acid
  misc_feature (31)..(31): n stands for inosine
cgaagaagcugaugaggccguuaggccgaanuauuccc

SEQ ID NO: 15596 - RNA, 38 nt, Artificial Sequence
  Description of Artificial Sequence:  Enzymatic Nucleic Acid
  misc_feature (31)..(31): n stands for inosine
ucgaagaacugaugaggccguuaggccgaanguauucc

SEQ ID NO: 15597 - RNA, 38 nt, Artificial Sequence
  Description of Artificial Sequence:  Enzymatic Nucleic Acid
  misc_feature (31)..(31): n stands for inosine
uucgaagacugaugaggccguuaggccgaangguauuc

SEQ ID NO: 15598 - RNA, 38 nt, Artificial Sequence
  Description of Artificial Sequence:  Enzymatic Nucleic Acid
  misc_feature (31)..(31): n stands for inosine
ugcuucgacugaugaggccguuaggccgaanaagggua

SEQ ID NO: 15599 - RNA, 38 nt, Artificial Sequence
  Description of Artificial Sequence:  Enzymatic Nucleic Acid
  misc_feature (31)..(31): n stands for inosine
uaugcugacugaugaggccguuaggccgaancuucgaa

SEQ ID NO: 15600 - RNA, 38 nt, Artificial Sequence
  Description of Artificial Sequence:  Enzymatic Nucleic Acid
  misc_feature (31)..(31): n stands for inosine
ucuuaugccugaugaggccguuaggccgaanaugcuuc

SEQ ID NO: 15601 - RNA, 38 nt, Artificial Sequence
  Description of Artificial Sequence:  Enzymatic Nucleic Acid
  misc_feature (31)..(31): n stands for inosine
guuucuuacugaugaggccguuaggccgaancugaugc

SEQ ID NO: 15602 - RNA, 38 nt, Artificial Sequence
  Description of Artificial Sequence:  Enzymatic Nucleic Acid
  misc_feature (31)..(31): n stands for inosine
gguuuacacugaugaggccguuaggccgaanuuucuua

SEQ ID NO: 15603 - RNA, 38 nt, Artificial Sequence
  Description of Artificial Sequence:  Enzymatic Nucleic Acid
  misc_feature (31)..(31): n stands for inosine
uaggucuccugaugaggccguuaggccgaanuuuacaa

SEQ ID NO: 15604 - RNA, 38 nt, Artificial Sequence
  Description of Artificial Sequence:  Enzymatic Nucleic Acid
  misc_feature (31)..(31): n stands for inosine
gguuuuuacugaugaggccguuaggccgaanucucggu

SEQ ID NO: 15605 - RNA, 38 nt, Artificial Sequence
  Description of Artificial Sequence:  Enzymatic Nucleic Acid
  misc_feature (31)..(31): n stands for inosine
ggguuuuucugaugaggccguuaggccgaangucucgg

SEQ ID NO: 15606 - RNA, 38 nt, Artificial Sequence
  Description of Artificial Sequence:  Enzymatic Nucleic Acid
  misc_feature (31)..(31): n stands for inosine
ccagacugcugaugaggccguuaggccgaanuuuuuag

SEQ ID NO: 15607 - RNA, 38 nt, Artificial Sequence
  Description of Artificial Sequence:  Enzymatic Nucleic Acid
  misc_feature (31)..(31): n stands for inosine
cccagacucugaugaggccguuaggccgaanguuuuua

SEQ ID NO: 15608 - RNA, 38 nt, Artificial Sequence
  Description of Artificial Sequence:  Enzymatic Nucleic Acid
  misc_feature (31)..(31): n stands for inosine
ucccagaccugaugaggccguuaggccgaangguuuuu

SEQ ID NO: 15609 - RNA, 38 nt, Artificial Sequence
  Description of Artificial Sequence:  Enzymatic Nucleic Acid
  misc_feature (31)..(31): n stands for inosine
ucacuccccugaugaggccguuaggccgaanacugggu

SEQ ID NO: 15610 - RNA, 38 nt, Artificial Sequence
  Description of Artificial Sequence:  Enzymatic Nucleic Acid
  misc_feature (31)..(31): n stands for inosine
aguuaaggcugaugaggccguuaggccgaancucaaaa

SEQ ID NO: 15611 - RNA, 38 nt, Artificial Sequence
  Description of Artificial Sequence:  Enzymatic Nucleic Acid
  misc_feature (31)..(31): n stands for inosine
auaguuaacugaugaggccguuaggccgaanugcucaa

SEQ ID NO: 15612 - RNA, 38 nt, Artificial Sequence
  Description of Artificial Sequence:  Enzymatic Nucleic Acid
  misc_feature (31)..(31): n stands for inosine
uauaguuacugaugaggccguuaggccgaangugcuca

SEQ ID NO: 15613 - RNA, 38 nt, Artificial Sequence
  Description of Artificial Sequence:  Enzymatic Nucleic Acid
  misc_feature (31)..(31): n stands for inosine
ccaucuaucugaugaggccguuaggccgaanuuaaggu

SEQ ID NO: 15614 - RNA, 38 nt, Artificial Sequence
  Description of Artificial Sequence:  Enzymatic Nucleic Acid
  misc_feature (31)..(31): n stands for inosine
ucacuccgcugaugaggccguuaggccgaanuuacacc

SEQ ID NO: 15615 - RNA, 38 nt, Artificial Sequence
  Description of Artificial Sequence:  Enzymatic Nucleic Acid
  misc_feature (31)..(31): n stands for inosine
gucacucccugaugaggccguuaggccgaanguuacac

SEQ ID NO: 15616 - RNA, 38 nt, Artificial Sequence
  Description of Artificial Sequence:  Enzymatic Nucleic Acid
  misc_feature (31)..(31): n stands for inosine
caauccuucugaugaggccguuaggccgaanucacucc

SEQ ID NO: 15617 - RNA, 38 nt, Artificial Sequence
  Description of Artificial Sequence:  Enzymatic Nucleic Acid
  misc_feature (31)..(31): n stands for inosine
acaauccucugaugaggccguuaggccgaangucacuc

SEQ ID NO: 15618 - RNA, 38 nt, Artificial Sequence
  Description of Artificial Sequence:  Enzymatic Nucleic Acid
  misc_feature (31)..(31): n stands for inosine
ugcacaggcugaugaggccguuaggccgaanuacaauc

SEQ ID NO: 15619 - RNA, 38 nt, Artificial Sequence
  Description of Artificial Sequence:  Enzymatic Nucleic Acid
  misc_feature (31)..(31): n stands for inosine
gcugcacacugaugaggccguuaggccgaanuguacaa

SEQ ID NO: 15620 - RNA, 38 nt, Artificial Sequence
  Description of Artificial Sequence:  Enzymatic Nucleic Acid
  misc_feature (31)..(31): n stands for inosine
ugcugcaccugaugaggccguuaggccgaanguguaca

SEQ ID NO: 15621 - RNA, 38 nt, Artificial Sequence
  Description of Artificial Sequence:  Enzymatic Nucleic Acid
  misc_feature (31)..(31): n stands for inosine
cuggaugccugaugaggccguuaggccgaancacaggu

SEQ ID NO: 15622 - RNA, 38 nt, Artificial Sequence
  Description of Artificial Sequence:  Enzymatic Nucleic Acid
  misc_feature (31)..(31): n stands for inosine
ccacuggacugaugaggccguuaggccgaancugcaca

SEQ ID NO: 15623 - RNA, 38 nt, Artificial Sequence
  Description of Artificial Sequence:  Enzymatic Nucleic Acid
  misc_feature (31)..(31): n stands for inosine
agcccacucugaugaggccguuaggccgaanaugcugc

SEQ ID NO: 15624 - RNA, 38 nt, Artificial Sequence
  Description of Artificial Sequence:  Enzymatic Nucleic Acid
  misc_feature (31)..(31): n stands for inosine
cagcccaccugaugaggccguuaggccgaangaugcug

SEQ ID NO: 15625 - RNA, 38 nt, Artificial Sequence
  Description of Artificial Sequence:  Enzymatic Nucleic Acid
  misc_feature (31)..(31): n stands for inosine
uggucauccugaugaggccguuaggccgaancccacug

SEQ ID NO: 15626 - RNA, 38 nt, Artificial Sequence
  Description of Artificial Sequence:  Enzymatic Nucleic Acid
  misc_feature (31)..(31): n stands for inosine
uucuucuucugaugaggccguuaggccgaanucaucag

SEQ ID NO: 15627 - RNA, 38 nt, Artificial Sequence
  Description of Artificial Sequence:  Enzymatic Nucleic Acid
  misc_feature (31)..(31): n stands for inosine
guucuucucugaugaggccguuaggccgaangucauca

SEQ ID NO: 15628 - RNA, 38 nt, Artificial Sequence
  Description of Artificial Sequence:  Enzymatic Nucleic Acid
  misc_feature (31)..(31): n stands for inosine
aaaugugccugaugaggccguuaggccgaanuucuucu

SEQ ID NO: 15629 - RNA, 38 nt, Artificial Sequence
  Description of Artificial Sequence:  Enzymatic Nucleic Acid
  misc_feature (31)..(31): n stands for inosine
gacaaaugcugaugaggccguuaggccgaancuguucu

SEQ ID NO: 15630 - RNA, 38 nt, Artificial Sequence
  Description of Artificial Sequence:  Enzymatic Nucleic Acid
  misc_feature (31)..(31): n stands for inosine
cugacaaacugaugaggccguuaggccgaanugcuguu

SEQ ID NO: 15631 - RNA, 38 nt, Artificial Sequence
  Description of Artificial Sequence:  Enzymatic Nucleic Acid
  misc_feature (31)..(31): n stands for inosine
auggaccccugaugaggccguuaggccgaanacaaaug

SEQ ID NO: 15632 - RNA, 38 nt, Artificial Sequence
  Description of Artificial Sequence:  Enzymatic Nucleic Acid
  misc_feature (31)..(31): n stands for inosine
uuuuucaucugaugaggccguuaggccgaanacccuga

SEQ ID NO: 15633 - RNA, 38 nt, Artificial Sequence
  Description of Artificial Sequence:  Enzymatic Nucleic Acid
  misc_feature (31)..(31): n stands for inosine
guuuuucacugaugaggccguuaggccgaangacccug

SEQ ID NO: 15634 - RNA, 38 nt, Artificial Sequence
  Description of Artificial Sequence:  Enzymatic Nucleic Acid
  misc_feature (31)..(31): n stands for inosine
caacaaaacugaugaggccguuaggccgaanuuuuuca

SEQ ID NO: 15635 - RNA, 38 nt, Artificial Sequence
  Description of Artificial Sequence:  Enzymatic Nucleic Acid
  misc_feature (31)..(31): n stands for inosine
gcaacaaacugaugaggccguuaggccgaanguuuuuc

SEQ ID NO: 15636 - RNA, 38 nt, Artificial Sequence
  Description of Artificial Sequence:  Enzymatic Nucleic Acid
  misc_feature (31)..(31): n stands for inosine
cuuccaaacugaugaggccguuaggccgaancaacaaa

SEQ ID NO: 15637 - RNA, 38 nt, Artificial Sequence
  Description of Artificial Sequence:  Enzymatic Nucleic Acid
  misc_feature (31)..(31): n stands for inosine
agauuccacugaugaggccguuaggccgaanccacuuc

SEQ ID NO: 15638 - RNA, 38 nt, Artificial Sequence
  Description of Artificial Sequence:  Enzymatic Nucleic Acid
  misc_feature (31)..(31): n stands for inosine
uccaccagcugaugaggccguuaggccgaanauuccau

SEQ ID NO: 15639 - RNA, 38 nt, Artificial Sequence
  Description of Artificial Sequence:  Enzymatic Nucleic Acid
  misc_feature (31)..(31): n stands for inosine
cuuccacccugaugaggccguuaggccgaanagauucc

SEQ ID NO: 15640 - RNA, 38 nt, Artificial Sequence
  Description of Artificial Sequence:  Enzymatic Nucleic Acid
  misc_feature (31)..(31): n stands for inosine
cccaccgucugaugaggccguuaggccgaancuuccac

SEQ ID NO: 15641 - RNA, 38 nt, Artificial Sequence
  Description of Artificial Sequence:  Enzymatic Nucleic Acid
  misc_feature (31)..(31): n stands for inosine
ccccaccgcugaugaggccguuaggccgaangcuucca

SEQ ID NO: 15642 - RNA, 38 nt, Artificial Sequence
  Description of Artificial Sequence:  Enzymatic Nucleic Acid
  misc_feature (31)..(31): n stands for inosine
agggauuccugaugaggccguuaggccgaanacacgcu

SEQ ID NO: 15643 - RNA, 38 nt, Artificial Sequence
  Description of Artificial Sequence:  Enzymatic Nucleic Acid
  misc_feature (31)..(31): n stands for inosine
cuucgcagcugaugaggccguuaggccgaanauucuga

SEQ ID NO: 15644 - RNA, 38 nt, Artificial Sequence
  Description of Artificial Sequence:  Enzymatic Nucleic Acid
  misc_feature (31)..(31): n stands for inosine
acuucgcacugaugaggccguuaggccgaangauucug

SEQ ID NO: 15645 - RNA, 38 nt, Artificial Sequence
  Description of Artificial Sequence:  Enzymatic Nucleic Acid
  misc_feature (31)..(31): n stands for inosine
uacuucgccugaugaggccguuaggccgaanggauucu

SEQ ID NO: 15646 - RNA, 38 nt, Artificial Sequence
  Description of Artificial Sequence:  Enzymatic Nucleic Acid
  misc_feature (31)..(31): n stands for inosine
guaaccaacugaugaggccguuaggccgaanuacuucg

SEQ ID NO: 15647 - RNA, 38 nt, Artificial Sequence
  Description of Artificial Sequence:  Enzymatic Nucleic Acid
  misc_feature (31)..(31): n stands for inosine
gguaaccacugaugaggccguuaggccgaanguacuuc

SEQ ID NO: 15648 - RNA, 38 nt, Artificial Sequence
  Description of Artificial Sequence:  Enzymatic Nucleic Acid
  misc_feature (31)..(31): n stands for inosine
ugggggugcugaugaggccguuaggccgaanuaaccaa

SEQ ID NO: 15649 - RNA, 38 nt, Artificial Sequence
  Description of Artificial Sequence:  Enzymatic Nucleic Acid
  misc_feature (31)..(31): n stands for inosine
cugggggucugaugaggccguuaggccgaanguaacca

SEQ ID NO: 15650 - RNA, 38 nt, Artificial Sequence
  Description of Artificial Sequence:  Enzymatic Nucleic Acid
  misc_feature (31)..(31): n stands for inosine
ucugggggcugaugaggccguuaggccgaangguaacc

SEQ ID NO: 15651 - RNA, 38 nt, Artificial Sequence
  Description of Artificial Sequence:  Enzymatic Nucleic Acid
  misc_feature (31)..(31): n stands for inosine
uuucugggcugaugaggccguuaggccgaanuggguaa

SEQ ID NO: 15652 - RNA, 38 nt, Artificial Sequence
  Description of Artificial Sequence:  Enzymatic Nucleic Acid
  misc_feature (31)..(31): n stands for inosine
auuucuggcugaugaggccguuaggccgaangugggua

SEQ ID NO: 15653 - RNA, 38 nt, Artificial Sequence
  Description of Artificial Sequence:  Enzymatic Nucleic Acid
  misc_feature (31)..(31): n stands for inosine
uauuucugcugaugaggccguuaggccgaanggugggu

SEQ ID NO: 15654 - RNA, 38 nt, Artificial Sequence
  Description of Artificial Sequence:  Enzymatic Nucleic Acid
  misc_feature (31)..(31): n stands for inosine
uuauuucucugaugaggccguuaggccgaanggguggg

SEQ ID NO: 15655 - RNA, 38 nt, Artificial Sequence
  Description of Artificial Sequence:  Enzymatic Nucleic Acid
  misc_feature (31)..(31): n stands for inosine
uuuauuuccugaugaggccguuaggccgaanggggugg

SEQ ID NO: 15656 - RNA, 38 nt, Artificial Sequence
  Description of Artificial Sequence:  Enzymatic Nucleic Acid
  misc_feature (31)..(31): n stands for inosine
acucaaggcugaugaggccguuaggccgaanuauucca

SEQ ID NO: 15657 - RNA, 38 nt, Artificial Sequence
  Description of Artificial Sequence:  Enzymatic Nucleic Acid
  misc_feature (31)..(31): n stands for inosine
gacucaagcugaugaggccguuaggccgaanguauucc

SEQ ID NO: 15658 - RNA, 38 nt, Artificial Sequence
  Description of Artificial Sequence:  Enzymatic Nucleic Acid
  misc_feature (31)..(31): n stands for inosine
ggacucaacugaugaggccguuaggccgaangguauuc

SEQ ID NO: 15659 - RNA, 38 nt, Artificial Sequence
  Description of Artificial Sequence:  Enzymatic Nucleic Acid
  misc_feature (31)..(31): n stands for inosine
uggacucacugaugaggccguuaggccgaanggguauu

SEQ ID NO: 15660 - RNA, 38 nt, Artificial Sequence
  Description of Artificial Sequence:  Enzymatic Nucleic Acid
  misc_feature (31)..(31): n stands for inosine
gugugauucugaugaggccguuaggccgaanacucaag

SEQ ID NO: 15661 - RNA, 38 nt, Artificial Sequence
  Description of Artificial Sequence:  Enzymatic Nucleic Acid
  misc_feature (31)..(31): n stands for inosine
ugugugaucugaugaggccguuaggccgaangacucaa

SEQ ID NO: 15662 - RNA, 38 nt, Artificial Sequence
  Description of Artificial Sequence:  Enzymatic Nucleic Acid
  misc_feature (31)..(31): n stands for inosine
uaauugugcugaugaggccguuaggccgaanauuggac

SEQ ID NO: 15663 - RNA, 38 nt, Artificial Sequence
  Description of Artificial Sequence:  Enzymatic Nucleic Acid
  misc_feature (31)..(31): n stands for inosine
uuuaauugcugaugaggccguuaggccgaanugauugg

SEQ ID NO: 15664 - RNA, 38 nt, Artificial Sequence
  Description of Artificial Sequence:  Enzymatic Nucleic Acid
  misc_feature (31)..(31): n stands for inosine
gcuuuaaucugaugaggccguuaggccgaanugugauu

SEQ ID NO: 15665 - RNA, 38 nt, Artificial Sequence
  Description of Artificial Sequence:  Enzymatic Nucleic Acid
  misc_feature (31)..(31): n stands for inosine
ucaguacacugaugaggccguuaggccgaanccccgcu

SEQ ID NO: 15666 - RNA, 38 nt, Artificial Sequence
  Description of Artificial Sequence:  Enzymatic Nucleic Acid
  misc_feature (31)..(31): n stands for inosine
uaaucguccugaugaggccguuaggccgaanuacaugc

SEQ ID NO: 15667 - RNA, 38 nt, Artificial Sequence
  Description of Artificial Sequence:  Enzymatic Nucleic Acid
  misc_feature (31)..(31): n stands for inosine
auuuccugcugaugaggccguuaggccgaanucucuuu

SEQ ID NO: 15668 - RNA, 38 nt, Artificial Sequence
  Description of Artificial Sequence:  Enzymatic Nucleic Acid
  misc_feature (31)..(31): n stands for inosine
uaauuucccugaugaggccguuaggccgaanugucucu

SEQ ID NO: 15669 - RNA, 38 nt, Artificial Sequence
  Description of Artificial Sequence:  Enzymatic Nucleic Acid
  misc_feature (31)..(31): n stands for inosine
gaugacagcugaugaggccguuaggccgaanuaauuuc

SEQ ID NO: 15670 - RNA, 38 nt, Artificial Sequence
  Description of Artificial Sequence:  Enzymatic Nucleic Acid
  misc_feature (31)..(31): n stands for inosine
aggaugaccugaugaggccguuaggccgaanuguaauu

SEQ ID NO: 15671 - RNA, 38 nt, Artificial Sequence
  Description of Artificial Sequence:  Enzymatic Nucleic Acid
  misc_feature (31)..(31): n stands for inosine
gguaaggacugaugaggccguuaggccgaanacagugu

SEQ ID NO: 15672 - RNA, 38 nt, Artificial Sequence
  Description of Artificial Sequence:  Enzymatic Nucleic Acid
  misc_feature (31)..(31): n stands for inosine
auugguaacugaugaggccguuaggccgaanaugacag

SEQ ID NO: 15673 - RNA, 38 nt, Artificial Sequence
  Description of Artificial Sequence:  Enzymatic Nucleic Acid
  misc_feature (31)..(31): n stands for inosine
gauugguacugaugaggccguuaggccgaangaugaca

SEQ ID NO: 15674 - RNA, 38 nt, Artificial Sequence
  Description of Artificial Sequence:  Enzymatic Nucleic Acid
  misc_feature (31)..(31): n stands for inosine
augggauucugaugaggccguuaggccgaanuaaggau

SEQ ID NO: 15675 - RNA, 38 nt, Artificial Sequence
  Description of Artificial Sequence:  Enzymatic Nucleic Acid
  misc_feature (31)..(31): n stands for inosine
aaugggaucugaugaggccguuaggccgaanguaagga

SEQ ID NO: 15676 - RNA, 38 nt, Artificial Sequence
  Description of Artificial Sequence:  Enzymatic Nucleic Acid
  misc_feature (31)..(31): n stands for inosine
uugaaaugcugaugaggccguuaggccgaanauuggua

SEQ ID NO: 15677 - RNA, 38 nt, Artificial Sequence
  Description of Artificial Sequence:  Enzymatic Nucleic Acid
  misc_feature (31)..(31): n stands for inosine
uuugaaaucugaugaggccguuaggccgaangauuggu

SEQ ID NO: 15678 - RNA, 38 nt, Artificial Sequence
  Description of Artificial Sequence:  Enzymatic Nucleic Acid
  misc_feature (31)..(31): n stands for inosine
cuuugaaacugaugaggccguuaggccgaanggauugg

SEQ ID NO: 15679 - RNA, 38 nt, Artificial Sequence
  Description of Artificial Sequence:  Enzymatic Nucleic Acid
  misc_feature (31)..(31): n stands for inosine
uucuccuucugaugaggccguuaggccgaanaaauggg

SEQ ID NO: 15680 - RNA, 38 nt, Artificial Sequence
  Description of Artificial Sequence:  Enzymatic Nucleic Acid
  misc_feature (31)..(31): n stands for inosine
cauggcuccugaugaggccguuaggccgaancuucucc

SEQ ID NO: 15681 - RNA, 38 nt, Artificial Sequence
  Description of Artificial Sequence:  Enzymatic Nucleic Acid
  misc_feature (31)..(31): n stands for inosine
gaccacaucugaugaggccguuaggccgaancucugcu

SEQ ID NO: 15682 - RNA, 38 nt, Artificial Sequence
  Description of Artificial Sequence:  Enzymatic Nucleic Acid
  misc_feature (31)..(31): n stands for inosine
agaccacacugaugaggccguuaggccgaangcucugc

SEQ ID NO: 15683 - RNA, 38 nt, Artificial Sequence
  Description of Artificial Sequence:  Enzymatic Nucleic Acid
  misc_feature (31)..(31): n stands for inosine
aaccagagcugaugaggccguuaggccgaanaccacau

SEQ ID NO: 15684 - RNA, 38 nt, Artificial Sequence
  Description of Artificial Sequence:  Enzymatic Nucleic Acid
  misc_feature (31)..(31): n stands for inosine
acaaccagcugaugaggccguuaggccgaanagaccac

SEQ ID NO: 15685 - RNA, 38 nt, Artificial Sequence
  Description of Artificial Sequence:  Enzymatic Nucleic Acid
  misc_feature (31)..(31): n stands for inosine
acacaacccugaugaggccguuaggccgaanagagacc

SEQ ID NO: 15686 - RNA, 38 nt, Artificial Sequence
  Description of Artificial Sequence:  Enzymatic Nucleic Acid
  misc_feature (31)..(31): n stands for inosine
cuggggugcugaugaggccguuaggccgaanacauaca

SEQ ID NO: 15687 - RNA, 38 nt, Artificial Sequence
  Description of Artificial Sequence:  Enzymatic Nucleic Acid
  misc_feature (31)..(31): n stands for inosine
ucuggggucugaugaggccguuaggccgaangacauac

SEQ ID NO: 15688 - RNA, 38 nt, Artificial Sequence
  Description of Artificial Sequence:  Enzymatic Nucleic Acid
  misc_feature (31)..(31): n stands for inosine
aucuggggcugaugaggccguuaggccgaanggacaua

SEQ ID NO: 15689 - RNA, 38 nt, Artificial Sequence
  Description of Artificial Sequence:  Enzymatic Nucleic Acid
  misc_feature (31)..(31): n stands for inosine
caaucuggcugaugaggccguuaggccgaanugggaca

SEQ ID NO: 15690 - RNA, 38 nt, Artificial Sequence
  Description of Artificial Sequence:  Enzymatic Nucleic Acid
  misc_feature (31)..(31): n stands for inosine
ccaaucugcugaugaggccguuaggccgaangugggac

SEQ ID NO: 15691 - RNA, 38 nt, Artificial Sequence
  Description of Artificial Sequence:  Enzymatic Nucleic Acid
  misc_feature (31)..(31): n stands for inosine
accaaucucugaugaggccguuaggccgaangguggga

SEQ ID NO: 15692 - RNA, 38 nt, Artificial Sequence
  Description of Artificial Sequence:  Enzymatic Nucleic Acid
  misc_feature (31)..(31): n stands for inosine
caccaauccugaugaggccguuaggccgaanggguggg

SEQ ID NO: 15693 - RNA, 38 nt, Artificial Sequence
  Description of Artificial Sequence:  Enzymatic Nucleic Acid
  misc_feature (31)..(31): n stands for inosine
gagauuagcugaugaggccguuaggccgaanauuucuc

SEQ ID NO: 15694 - RNA, 38 nt, Artificial Sequence
  Description of Artificial Sequence:  Enzymatic Nucleic Acid
  misc_feature (31)..(31): n stands for inosine
gagagauucugaugaggccguuaggccgaanagauuuc

SEQ ID NO: 15695 - RNA, 38 nt, Artificial Sequence
  Description of Artificial Sequence:  Enzymatic Nucleic Acid
  misc_feature (31)..(31): n stands for inosine
cacaggagcugaugaggccguuaggccgaanauuagag

SEQ ID NO: 15696 - RNA, 38 nt, Artificial Sequence
  Description of Artificial Sequence:  Enzymatic Nucleic Acid
  misc_feature (31)..(31): n stands for inosine
uccacaggcugaugaggccguuaggccgaanagauuag

SEQ ID NO: 15697 - RNA, 38 nt, Artificial Sequence
  Description of Artificial Sequence:  Enzymatic Nucleic Acid
  misc_feature (31)..(31): n stands for inosine
aauccacacugaugaggccguuaggccgaanagagauu

SEQ ID NO: 15698 - RNA, 38 nt, Artificial Sequence
  Description of Artificial Sequence:  Enzymatic Nucleic Acid
  misc_feature (31)..(31): n stands for inosine
gaauccaccugaugaggccguuaggccgaangagagau

SEQ ID NO: 15699 - RNA, 38 nt, Artificial Sequence
  Description of Artificial Sequence:  Enzymatic Nucleic Acid
  misc_feature (31)..(31): n stands for inosine
uacugguacugaugaggccguuaggccgaanaauccac

SEQ ID NO: 15700 - RNA, 38 nt, Artificial Sequence
  Description of Artificial Sequence:  Enzymatic Nucleic Acid
  misc_feature (31)..(31): n stands for inosine
guacuggucugaugaggccguuaggccgaangaaucca

SEQ ID NO: 15701 - RNA, 38 nt, Artificial Sequence
  Description of Artificial Sequence:  Enzymatic Nucleic Acid
  misc_feature (31)..(31): n stands for inosine
gccguacucugaugaggccguuaggccgaanuaggaau

SEQ ID NO: 15702 - RNA, 38 nt, Artificial Sequence
  Description of Artificial Sequence:  Enzymatic Nucleic Acid
  misc_feature (31)..(31): n stands for inosine
ugccguaccugaugaggccguuaggccgaanguaggaa

SEQ ID NO: 15703 - RNA, 38 nt, Artificial Sequence
  Description of Artificial Sequence:  Enzymatic Nucleic Acid
  misc_feature (31)..(31): n stands for inosine
uugaguggcugaugaggccguuaggccgaanccguacu

SEQ ID NO: 15704 - RNA, 38 nt, Artificial Sequence
  Description of Artificial Sequence:  Enzymatic Nucleic Acid
  misc_feature (31)..(31): n stands for inosine
guuugagucugaugaggccguuaggccgaanugccgua

SEQ ID NO: 15705 - RNA, 38 nt, Artificial Sequence
  Description of Artificial Sequence:  Enzymatic Nucleic Acid
  misc_feature (31)..(31): n stands for inosine
cguuugagcugaugaggccguuaggccgaangugccgu

SEQ ID NO: 15706 - RNA, 38 nt, Artificial Sequence
  Description of Artificial Sequence:  Enzymatic Nucleic Acid
  misc_feature (31)..(31): n stands for inosine
agcguuugcugaugaggccguuaggccgaanuggugcc

SEQ ID NO: 15707 - RNA, 38 nt, Artificial Sequence
  Description of Artificial Sequence:  Enzymatic Nucleic Acid
  misc_feature (31)..(31): n stands for inosine
ucagcguucugaugaggccguuaggccgaanaguggug

SEQ ID NO: 15708 - RNA, 38 nt, Artificial Sequence
  Description of Artificial Sequence:  Enzymatic Nucleic Acid
  misc_feature (31)..(31): n stands for inosine
uacauguccugaugaggccguuaggccgaancguuuga

SEQ ID NO: 15709 - RNA, 38 nt, Artificial Sequence
  Description of Artificial Sequence:  Enzymatic Nucleic Acid
  misc_feature (31)..(31): n stands for inosine
accguacacugaugaggccguuaggccgaanucagcgu

SEQ ID NO: 15710 - RNA, 38 nt, Artificial Sequence
  Description of Artificial Sequence:  Enzymatic Nucleic Acid
  misc_feature (31)..(31): n stands for inosine
aauggcaucugaugaggccguuaggccgaanaccguac

SEQ ID NO: 15711 - RNA, 38 nt, Artificial Sequence
  Description of Artificial Sequence:  Enzymatic Nucleic Acid
  misc_feature (31)..(31): n stands for inosine
ggaggaaucugaugaggccguuaggccgaancauagac

SEQ ID NO: 15712 - RNA, 38 nt, Artificial Sequence
  Description of Artificial Sequence:  Enzymatic Nucleic Acid
  misc_feature (31)..(31): n stands for inosine
gggaggaacugaugaggccguuaggccgaangcauaga

SEQ ID NO: 15713 - RNA, 38 nt, Artificial Sequence
  Description of Artificial Sequence:  Enzymatic Nucleic Acid
  misc_feature (31)..(31): n stands for inosine
gcgggggacugaugaggccguuaggccgaanaauggca

SEQ ID NO: 15714 - RNA, 38 nt, Artificial Sequence
  Description of Artificial Sequence:  Enzymatic Nucleic Acid
  misc_feature (31)..(31): n stands for inosine
ugcgggggcugaugaggccguuaggccgaangaauggc

SEQ ID NO: 15715 - RNA, 38 nt, Artificial Sequence
  Description of Artificial Sequence:  Enzymatic Nucleic Acid
  misc_feature (31)..(31): n stands for inosine
gaugcgggcugaugaggccguuaggccgaanaggaaug

SEQ ID NO: 15716 - RNA, 38 nt, Artificial Sequence
  Description of Artificial Sequence:  Enzymatic Nucleic Acid
  misc_feature (31)..(31): n stands for inosine
ugaugcggcugaugaggccguuaggccgaangaggaau

SEQ ID NO: 15717 - RNA, 38 nt, Artificial Sequence
  Description of Artificial Sequence:  Enzymatic Nucleic Acid
  misc_feature (31)..(31): n stands for inosine
gugaugcgcugaugaggccguuaggccgaanggaggaa

SEQ ID NO: 15718 - RNA, 38 nt, Artificial Sequence
  Description of Artificial Sequence:  Enzymatic Nucleic Acid
  misc_feature (31)..(31): n stands for inosine
ugugaugccugaugaggccguuaggccgaangggagga

SEQ ID NO: 15719 - RNA, 38 nt, Artificial Sequence
  Description of Artificial Sequence:  Enzymatic Nucleic Acid
  misc_feature (31)..(31): n stands for inosine
ggaugugacugaugaggccguuaggccgaancggggga

SEQ ID NO: 15720 - RNA, 38 nt, Artificial Sequence
  Description of Artificial Sequence:  Enzymatic Nucleic Acid
  misc_feature (31)..(31): n stands for inosine
aguggaugcugaugaggccguuaggccgaanaugcggg

SEQ ID NO: 15721 - RNA, 38 nt, Artificial Sequence
  Description of Artificial Sequence:  Enzymatic Nucleic Acid
  misc_feature (31)..(31): n stands for inosine
ccaguggacugaugaggccguuaggccgaanugaugcg

SEQ ID NO: 15722 - RNA, 38 nt, Artificial Sequence
  Description of Artificial Sequence:  Enzymatic Nucleic Acid
  misc_feature (31)..(31): n stands for inosine
auaccagucugaugaggccguuaggccgaanaugugau

SEQ ID NO: 15723 - RNA, 38 nt, Artificial Sequence
  Description of Artificial Sequence:  Enzymatic Nucleic Acid
  misc_feature (31)..(31): n stands for inosine
aauaccagcugaugaggccguuaggccgaangauguga

SEQ ID NO: 15724 - RNA, 38 nt, Artificial Sequence
  Description of Artificial Sequence:  Enzymatic Nucleic Acid
  misc_feature (31)..(31): n stands for inosine
ccaauacccugaugaggccguuaggccgaanuggaugu

SEQ ID NO: 15725 - RNA, 38 nt, Artificial Sequence
  Description of Artificial Sequence:  Enzymatic Nucleic Acid
  misc_feature (31)..(31): n stands for inosine
ccuccaaccugaugaggccguuaggccgaanccaauac

SEQ ID NO: 15726 - RNA, 38 nt, Artificial Sequence
  Description of Artificial Sequence:  Enzymatic Nucleic Acid
  misc_feature (31)..(31): n stands for inosine
ggcucguucugaugaggccguuaggccgaancgcacuc

SEQ ID NO: 15727 - RNA, 38 nt, Artificial Sequence
  Description of Artificial Sequence:  Enzymatic Nucleic Acid
  misc_feature (31)..(31): n stands for inosine
gggcucgucugaugaggccguuaggccgaangcgcacu

SEQ ID NO: 15728 - RNA, 38 nt, Artificial Sequence
  Description of Artificial Sequence:  Enzymatic Nucleic Acid
  misc_feature (31)..(31): n stands for inosine
cuuggcugcugaugaggccguuaggccgaancucguug

SEQ ID NO: 15729 - RNA, 38 nt, Artificial Sequence
  Description of Artificial Sequence:  Enzymatic Nucleic Acid
  misc_feature (31)..(31): n stands for inosine
gcuuggcucugaugaggccguuaggccgaangcucguu

SEQ ID NO: 15730 - RNA, 38 nt, Artificial Sequence
  Description of Artificial Sequence:  Enzymatic Nucleic Acid
  misc_feature (31)..(31): n stands for inosine
agcuuggccugaugaggccguuaggccgaanggcucgu

SEQ ID NO: 15731 - RNA, 38 nt, Artificial Sequence
  Description of Artificial Sequence:  Enzymatic Nucleic Acid
  misc_feature (31)..(31): n stands for inosine
gacagcuucugaugaggccguuaggccgaancugggcu

SEQ ID NO: 15732 - RNA, 38 nt, Artificial Sequence
  Description of Artificial Sequence:  Enzymatic Nucleic Acid
  misc_feature (31)..(31): n stands for inosine
agacagcucugaugaggccguuaggccgaangcugggc

SEQ ID NO: 15733 - RNA, 38 nt, Artificial Sequence
  Description of Artificial Sequence:  Enzymatic Nucleic Acid
  misc_feature (31)..(31): n stands for inosine
acugagaccugaugaggccguuaggccgaancuuggcu

SEQ ID NO: 15734 - RNA, 38 nt, Artificial Sequence
  Description of Artificial Sequence:  Enzymatic Nucleic Acid
  misc_feature (31)..(31): n stands for inosine
ugucacugcugaugaggccguuaggccgaanacagcuu

SEQ ID NO: 15735 - RNA, 38 nt, Artificial Sequence
  Description of Artificial Sequence:  Enzymatic Nucleic Acid
  misc_feature (31)..(31): n stands for inosine
uuugucaccugaugaggccguuaggccgaanagacagc

SEQ ID NO: 15736 - RNA, 38 nt, Artificial Sequence
  Description of Artificial Sequence:  Enzymatic Nucleic Acid
  misc_feature (31)..(31): n stands for inosine
uauggguucugaugaggccguuaggccgaanucacuga

SEQ ID NO: 15737 - RNA, 38 nt, Artificial Sequence
  Description of Artificial Sequence:  Enzymatic Nucleic Acid
  misc_feature (31)..(31): n stands for inosine
aggguaugcugaugaggccguuaggccgaanuuuguca

SEQ ID NO: 15738 - RNA, 38 nt, Artificial Sequence
  Description of Artificial Sequence:  Enzymatic Nucleic Acid
  misc_feature (31)..(31): n stands for inosine
aaggguaucugaugaggccguuaggccgaanguuuguc

SEQ ID NO: 15739 - RNA, 38 nt, Artificial Sequence
  Description of Artificial Sequence:  Enzymatic Nucleic Acid
  misc_feature (31)..(31): n stands for inosine
caaggguacugaugaggccguuaggccgaangguuugu

SEQ ID NO: 15740 - RNA, 38 nt, Artificial Sequence
  Description of Artificial Sequence:  Enzymatic Nucleic Acid
  misc_feature (31)..(31): n stands for inosine
uucacaagcugaugaggccguuaggccgaanuaugggu

SEQ ID NO: 15741 - RNA, 38 nt, Artificial Sequence
  Description of Artificial Sequence:  Enzymatic Nucleic Acid
  misc_feature (31)..(31): n stands for inosine
cuucacaacugaugaggccguuaggccgaanguauggg

SEQ ID NO: 15742 - RNA, 38 nt, Artificial Sequence
  Description of Artificial Sequence:  Enzymatic Nucleic Acid
  misc_feature (31)..(31): n stands for inosine
ucuucacacugaugaggccguuaggccgaangguaugg

SEQ ID NO: 15743 - RNA, 38 nt, Artificial Sequence
  Description of Artificial Sequence:  Enzymatic Nucleic Acid
  misc_feature (31)..(31): n stands for inosine
ucccuggacugaugaggccguuaggccgaanuccucca

SEQ ID NO: 15744 - RNA, 38 nt, Artificial Sequence
  Description of Artificial Sequence:  Enzymatic Nucleic Acid
  misc_feature (31)..(31): n stands for inosine
uccucccucugaugaggccguuaggccgaanaaguccu

SEQ ID NO: 15745 - RNA, 38 nt, Artificial Sequence
  Description of Artificial Sequence:  Enzymatic Nucleic Acid
  misc_feature (31)..(31): n stands for inosine
uuccuccccugaugaggccguuaggccgaangaagucc

SEQ ID NO: 15746 - RNA, 38 nt, Artificial Sequence
  Description of Artificial Sequence:  Enzymatic Nucleic Acid
  misc_feature (31)..(31): n stands for inosine
gagcaaaucugaugaggccguuaggccgaanauuuuua

SEQ ID NO: 15747 - RNA, 38 nt, Artificial Sequence
  Description of Artificial Sequence:  Enzymatic Nucleic Acid
  misc_feature (31)..(31): n stands for inosine
ucaauuagcugaugaggccguuaggccgaancaaauug

SEQ ID NO: 15748 - RNA, 38 nt, Artificial Sequence
  Description of Artificial Sequence:  Enzymatic Nucleic Acid
  misc_feature (31)..(31): n stands for inosine
cuucaauucugaugaggccguuaggccgaanagcaaau

SEQ ID NO: 15749 - RNA, 38 nt, Artificial Sequence
  Description of Artificial Sequence:  Enzymatic Nucleic Acid
  misc_feature (31)..(31): n stands for inosine
uacaguuucugaugaggccguuaggccgaanuuuuuuc

SEQ ID NO: 15750 - RNA, 38 nt, Artificial Sequence
  Description of Artificial Sequence:  Enzymatic Nucleic Acid
  misc_feature (31)..(31): n stands for inosine
guacuuaccugaugaggccguuaggccgaanuuuuguu

SEQ ID NO: 15751 - RNA, 38 nt, Artificial Sequence
  Description of Artificial Sequence:  Enzymatic Nucleic Acid
  misc_feature (31)..(31): n stands for inosine
auaacaagcugaugaggccguuaggccgaanuacuuac

SEQ ID NO: 15752 - RNA, 38 nt, Artificial Sequence
  Description of Artificial Sequence:  Enzymatic Nucleic Acid
  misc_feature (31)..(31): n stands for inosine
gauaacaacugaugaggccguuaggccgaanguacuua

SEQ ID NO: 15753 - RNA, 38 nt, Artificial Sequence
  Description of Artificial Sequence:  Enzymatic Nucleic Acid
  misc_feature (31)..(31): n stands for inosine
ggauaacacugaugaggccguuaggccgaangguacuu

SEQ ID NO: 15754 - RNA, 38 nt, Artificial Sequence
  Description of Artificial Sequence:  Enzymatic Nucleic Acid
  misc_feature (31)..(31): n stands for inosine
ugccgcuucugaugaggccguuaggccgaanauaacaa

SEQ ID NO: 15755 - RNA, 38 nt, Artificial Sequence
  Description of Artificial Sequence:  Enzymatic Nucleic Acid
  misc_feature (31)..(31): n stands for inosine
uugccgcucugaugaggccguuaggccgaangauaaca

SEQ ID NO: 15756 - RNA, 38 nt, Artificial Sequence
  Description of Artificial Sequence:  Enzymatic Nucleic Acid
  misc_feature (31)..(31): n stands for inosine
gacacauucugaugaggccguuaggccgaanccgcuug

SEQ ID NO: 15757 - RNA, 38 nt, Artificial Sequence
  Description of Artificial Sequence:  Enzymatic Nucleic Acid
  misc_feature (31)..(31): n stands for inosine
uacaaagccugaugaggccguuaggccgaanacacauu

SEQ ID NO: 15758 - RNA, 38 nt, Artificial Sequence
  Description of Artificial Sequence:  Enzymatic Nucleic Acid
  misc_feature (31)..(31): n stands for inosine
uuguacaacugaugaggccguuaggccgaancugacac

SEQ ID NO: 15759 - RNA, 38 nt, Artificial Sequence
  Description of Artificial Sequence:  Enzymatic Nucleic Acid
  misc_feature (31)..(31): n stands for inosine
uucacauucugaugaggccguuaggccgaanuacaaag

SEQ ID NO: 15760 - RNA, 38 nt, Artificial Sequence
  Description of Artificial Sequence:  Enzymatic Nucleic Acid
  misc_feature (31)..(31): n stands for inosine
gacuuugucugaugaggccguuaggccgaanaccgcuu

SEQ ID NO: 15761 - RNA, 38 nt, Artificial Sequence
  Description of Artificial Sequence:  Enzymatic Nucleic Acid
  misc_feature (31)..(31): n stands for inosine
cccgacuucugaugaggccguuaggccgaanuugaccg

SEQ ID NO: 15762 - RNA, 38 nt, Artificial Sequence
  Description of Artificial Sequence:  Enzymatic Nucleic Acid
  misc_feature (31)..(31): n stands for inosine
guggaaggcugaugaggccguuaggccgaanaucaccc

SEQ ID NO: 15763 - RNA, 38 nt, Artificial Sequence
  Description of Artificial Sequence:  Enzymatic Nucleic Acid
  misc_feature (31)..(31): n stands for inosine
acguggaacugaugaggccguuaggccgaanagaucac

SEQ ID NO: 15764 - RNA, 38 nt, Artificial Sequence
  Description of Artificial Sequence:  Enzymatic Nucleic Acid
  misc_feature (31)..(31): n stands for inosine
cacguggacugaugaggccguuaggccgaangagauca

SEQ ID NO: 15765 - RNA, 38 nt, Artificial Sequence
  Description of Artificial Sequence:  Enzymatic Nucleic Acid
  misc_feature (31)..(31): n stands for inosine
ggucacgucugaugaggccguuaggccgaanaaggaga

SEQ ID NO: 15766 - RNA, 38 nt, Artificial Sequence
  Description of Artificial Sequence:  Enzymatic Nucleic Acid
  misc_feature (31)..(31): n stands for inosine
uggucacgcugaugaggccguuaggccgaangaaggag

SEQ ID NO: 15767 - RNA, 38 nt, Artificial Sequence
  Description of Artificial Sequence:  Enzymatic Nucleic Acid
  misc_feature (31)..(31): n stands for inosine
ggaccccucugaugaggccguuaggccgaanucacgug

SEQ ID NO: 15768 - RNA, 38 nt, Artificial Sequence
  Description of Artificial Sequence:  Enzymatic Nucleic Acid
  misc_feature (31)..(31): n stands for inosine
aggacccccugaugaggccguuaggccgaangucacgu

SEQ ID NO: 15769 - RNA, 38 nt, Artificial Sequence
  Description of Artificial Sequence:  Enzymatic Nucleic Acid
  misc_feature (31)..(31): n stands for inosine
uaauuucacugaugaggccguuaggccgaanaccccug

SEQ ID NO: 15770 - RNA, 38 nt, Artificial Sequence
  Description of Artificial Sequence:  Enzymatic Nucleic Acid
  misc_feature (31)..(31): n stands for inosine
guaauuuccugaugaggccguuaggccgaangaccccu

SEQ ID NO: 15771 - RNA, 38 nt, Artificial Sequence
  Description of Artificial Sequence:  Enzymatic Nucleic Acid
  misc_feature (31)..(31): n stands for inosine
gguugcaacugaugaggccguuaggccgaanuaauuuc

SEQ ID NO: 15772 - RNA, 38 nt, Artificial Sequence
  Description of Artificial Sequence:  Enzymatic Nucleic Acid
  misc_feature (31)..(31): n stands for inosine
ugucaggucugaugaggccguuaggccgaancaaagua

SEQ ID NO: 15773 - RNA, 38 nt, Artificial Sequence
  Description of Artificial Sequence:  Enzymatic Nucleic Acid
  misc_feature (31)..(31): n stands for inosine
gcaugucacugaugaggccguuaggccgaanuugcaaa

SEQ ID NO: 15774 - RNA, 38 nt, Artificial Sequence
  Description of Artificial Sequence:  Enzymatic Nucleic Acid
  misc_feature (31)..(31): n stands for inosine
ugcauguccugaugaggccguuaggccgaanguugcaa

SEQ ID NO: 15775 - RNA, 38 nt, Artificial Sequence
  Description of Artificial Sequence:  Enzymatic Nucleic Acid
  misc_feature (31)..(31): n stands for inosine
gggcugcacugaugaggccguuaggccgaanucagguu

SEQ ID NO: 15776 - RNA, 38 nt, Artificial Sequence
  Description of Artificial Sequence:  Enzymatic Nucleic Acid
  misc_feature (31)..(31): n stands for inosine
cagugggccugaugaggccguuaggccgaancauguca

SEQ ID NO: 15777 - RNA, 38 nt, Artificial Sequence
  Description of Artificial Sequence:  Enzymatic Nucleic Acid
  misc_feature (31)..(31): n stands for inosine
gcucagugcugaugaggccguuaggccgaancugcaug

SEQ ID NO: 15778 - RNA, 38 nt, Artificial Sequence
  Description of Artificial Sequence:  Enzymatic Nucleic Acid
  misc_feature (31)..(31): n stands for inosine
ugcucagucugaugaggccguuaggccgaangcugcau

SEQ ID NO: 15779 - RNA, 38 nt, Artificial Sequence
  Description of Artificial Sequence:  Enzymatic Nucleic Acid
  misc_feature (31)..(31): n stands for inosine
cugcucagcugaugaggccguuaggccgaanggcugca

SEQ ID NO: 15780 - RNA, 38 nt, Artificial Sequence
  Description of Artificial Sequence:  Enzymatic Nucleic Acid
  misc_feature (31)..(31): n stands for inosine
uccugcuccugaugaggccguuaggccgaanugggcug

SEQ ID NO: 15781 - RNA, 38 nt, Artificial Sequence
  Description of Artificial Sequence:  Enzymatic Nucleic Acid
  misc_feature (31)..(31): n stands for inosine
cgcucucccugaugaggccguuaggccgaancucagug

SEQ ID NO: 15782 - RNA, 38 nt, Artificial Sequence
  Description of Artificial Sequence:  Enzymatic Nucleic Acid
  misc_feature (31)..(31): n stands for inosine
caccacaacugaugaggccguuaggccgaanacacgcu

SEQ ID NO: 15783 - RNA, 38 nt, Artificial Sequence
  Description of Artificial Sequence:  Enzymatic Nucleic Acid
  misc_feature (31)..(31): n stands for inosine
gucugcagcugaugaggccguuaggccgaancaccaca

SEQ ID NO: 15784 - RNA, 38 nt, Artificial Sequence
  Description of Artificial Sequence:  Enzymatic Nucleic Acid
  misc_feature (31)..(31): n stands for inosine
cugucugccugaugaggccguuaggccgaanugcacca

SEQ ID NO: 15785 - RNA, 38 nt, Artificial Sequence
  Description of Artificial Sequence:  Enzymatic Nucleic Acid
  misc_feature (31)..(31): n stands for inosine
gaucuguccugaugaggccguuaggccgaancagugca

SEQ ID NO: 15786 - RNA, 38 nt, Artificial Sequence
  Description of Artificial Sequence:  Enzymatic Nucleic Acid
  misc_feature (31)..(31): n stands for inosine
cguagauccugaugaggccguuaggccgaanucugcag

SEQ ID NO: 15787 - RNA, 38 nt, Artificial Sequence
  Description of Artificial Sequence:  Enzymatic Nucleic Acid
  misc_feature (31)..(31): n stands for inosine
ucaaacgucugaugaggccguuaggccgaanaucuguc

SEQ ID NO: 15788 - RNA, 38 nt, Artificial Sequence
  Description of Artificial Sequence:  Enzymatic Nucleic Acid
  misc_feature (31)..(31): n stands for inosine
ccaugugacugaugaggccguuaggccgaanuucucaa

SEQ ID NO: 15789 - RNA, 38 nt, Artificial Sequence
  Description of Artificial Sequence:  Enzymatic Nucleic Acid
  misc_feature (31)..(31): n stands for inosine
accaugugcugaugaggccguuaggccgaanguucuca

SEQ ID NO: 15790 - RNA, 38 nt, Artificial Sequence
  Description of Artificial Sequence:  Enzymatic Nucleic Acid
  misc_feature (31)..(31): n stands for inosine
guaccaugcugaugaggccguuaggccgaanagguucu

SEQ ID NO: 15791 - RNA, 38 nt, Artificial Sequence
  Description of Artificial Sequence:  Enzymatic Nucleic Acid
  misc_feature (31)..(31): n stands for inosine
uuguaccacugaugaggccguuaggccgaanugagguu

SEQ ID NO: 15792 - RNA, 38 nt, Artificial Sequence
  Description of Artificial Sequence:  Enzymatic Nucleic Acid
  misc_feature (31)..(31): n stands for inosine
gccaagcucugaugaggccguuaggccgaanuaccaug

SEQ ID NO: 15793 - RNA, 38 nt, Artificial Sequence
  Description of Artificial Sequence:  Enzymatic Nucleic Acid
  misc_feature (31)..(31): n stands for inosine
gugggccacugaugaggccguuaggccgaancuuguac

SEQ ID NO: 15794 - RNA, 38 nt, Artificial Sequence
  Description of Artificial Sequence:  Enzymatic Nucleic Acid
  misc_feature (31)..(31): n stands for inosine
aggcugugcugaugaggccguuaggccgaanccaagcu

SEQ ID NO: 15795 - RNA, 38 nt, Artificial Sequence
  Description of Artificial Sequence:  Enzymatic Nucleic Acid
  misc_feature (31)..(31): n stands for inosine
gaggcugucugaugaggccguuaggccgaangccaagc

SEQ ID NO: 15796 - RNA, 38 nt, Artificial Sequence
  Description of Artificial Sequence:  Enzymatic Nucleic Acid
  misc_feature (31)..(31): n stands for inosine
agaggcugcugaugaggccguuaggccgaanggccaag

SEQ ID NO: 15797 - RNA, 38 nt, Artificial Sequence
  Description of Artificial Sequence:  Enzymatic Nucleic Acid
  misc_feature (31)..(31): n stands for inosine
gcagaggccugaugaggccguuaggccgaanugggcca

SEQ ID NO: 15798 - RNA, 38 nt, Artificial Sequence
  Description of Artificial Sequence:  Enzymatic Nucleic Acid
  misc_feature (31)..(31): n stands for inosine
uuggcagacugaugaggccguuaggccgaancuguggg

SEQ ID NO: 15799 - RNA, 38 nt, Artificial Sequence
  Description of Artificial Sequence:  Enzymatic Nucleic Acid
  misc_feature (31)..(31): n stands for inosine
auuggcagcugaugaggccguuaggccgaangcugugg

SEQ ID NO: 15800 - RNA, 38 nt, Artificial Sequence
  Description of Artificial Sequence:  Enzymatic Nucleic Acid
  misc_feature (31)..(31): n stands for inosine
ggauuggccugaugaggccguuaggccgaanaggcugu

SEQ ID NO: 15801 - RNA, 38 nt, Artificial Sequence
  Description of Artificial Sequence:  Enzymatic Nucleic Acid
  misc_feature (31)..(31): n stands for inosine
cauggauucugaugaggccguuaggccgaancagaggc

SEQ ID NO: 15802 - RNA, 38 nt, Artificial Sequence
  Description of Artificial Sequence:  Enzymatic Nucleic Acid
  misc_feature (31)..(31): n stands for inosine
acauggaucugaugaggccguuaggccgaangcagagg

SEQ ID NO: 15803 - RNA, 38 nt, Artificial Sequence
  Description of Artificial Sequence:  Enzymatic Nucleic Acid
  misc_feature (31)..(31): n stands for inosine
ucccacaucugaugaggccguuaggccgaanauuggca

SEQ ID NO: 15804 - RNA, 38 nt, Artificial Sequence
  Description of Artificial Sequence:  Enzymatic Nucleic Acid
  misc_feature (31)..(31): n stands for inosine
cucccacacugaugaggccguuaggccgaangauuggc

SEQ ID NO: 15805 - RNA, 38 nt, Artificial Sequence
  Description of Artificial Sequence:  Enzymatic Nucleic Acid
  misc_feature (31)..(31): n stands for inosine
caggugugcugaugaggccguuaggccgaancaacucu

SEQ ID NO: 15806 - RNA, 38 nt, Artificial Sequence
  Description of Artificial Sequence:  Enzymatic Nucleic Acid
  misc_feature (31)..(31): n stands for inosine
acaggugucugaugaggccguuaggccgaangcaacuc

SEQ ID NO: 15807 - RNA, 38 nt, Artificial Sequence
  Description of Artificial Sequence:  Enzymatic Nucleic Acid
  misc_feature (31)..(31): n stands for inosine
aacaggugcugaugaggccguuaggccgaanggcaacu

SEQ ID NO: 15808 - RNA, 38 nt, Artificial Sequence
  Description of Artificial Sequence:  Enzymatic Nucleic Acid
  misc_feature (31)..(31): n stands for inosine
caaacaggcugaugaggccguuaggccgaanugggcaa

SEQ ID NO: 15809 - RNA, 38 nt, Artificial Sequence
  Description of Artificial Sequence:  Enzymatic Nucleic Acid
  misc_feature (31)..(31): n stands for inosine
ugcaaacacugaugaggccguuaggccgaanugugggc

SEQ ID NO: 15810 - RNA, 38 nt, Artificial Sequence
  Description of Artificial Sequence:  Enzymatic Nucleic Acid
  misc_feature (31)..(31): n stands for inosine
uugcaaaccugaugaggccguuaggccgaanguguggg

SEQ ID NO: 15811 - RNA, 38 nt, Artificial Sequence
  Description of Artificial Sequence:  Enzymatic Nucleic Acid
  misc_feature (31)..(31): n stands for inosine
caaguucucugaugaggccguuaggccgaancaaacag

SEQ ID NO: 15812 - RNA, 38 nt, Artificial Sequence
  Description of Artificial Sequence:  Enzymatic Nucleic Acid
  misc_feature (31)..(31): n stands for inosine
aguauccacugaugaggccguuaggccgaanuucuugc

SEQ ID NO: 15813 - RNA, 38 nt, Artificial Sequence
  Description of Artificial Sequence:  Enzymatic Nucleic Acid
  misc_feature (31)..(31): n stands for inosine
uuccaaagcugaugaggccguuaggccgaanuauccaa

SEQ ID NO: 15814 - RNA, 38 nt, Artificial Sequence
  Description of Artificial Sequence:  Enzymatic Nucleic Acid
  misc_feature (31)..(31): n stands for inosine
auuuccaacugaugaggccguuaggccgaanaguaucc

SEQ ID NO: 15815 - RNA, 38 nt, Artificial Sequence
  Description of Artificial Sequence:  Enzymatic Nucleic Acid
  misc_feature (31)..(31): n stands for inosine
aacauggucugaugaggccguuaggccgaancauucaa

SEQ ID NO: 15816 - RNA, 38 nt, Artificial Sequence
  Description of Artificial Sequence:  Enzymatic Nucleic Acid
  misc_feature (31)..(31): n stands for inosine
gaacauggcugaugaggccguuaggccgaangcauuca

SEQ ID NO: 15817 - RNA, 38 nt, Artificial Sequence
  Description of Artificial Sequence:  Enzymatic Nucleic Acid
  misc_feature (31)..(31): n stands for inosine
gagaacaucugaugaggccguuaggccgaanuggcauu

SEQ ID NO: 15818 - RNA, 38 nt, Artificial Sequence
  Description of Artificial Sequence:  Enzymatic Nucleic Acid
  misc_feature (31)..(31): n stands for inosine
agagaacacugaugaggccguuaggccgaanguggcau

SEQ ID NO: 15819 - RNA, 38 nt, Artificial Sequence
  Description of Artificial Sequence:  Enzymatic Nucleic Acid
  misc_feature (31)..(31): n stands for inosine
gcuauuagcugaugaggccguuaggccgaanaacaugg

SEQ ID NO: 15820 - RNA, 38 nt, Artificial Sequence
  Description of Artificial Sequence:  Enzymatic Nucleic Acid
  misc_feature (31)..(31): n stands for inosine
gugcuauucugaugaggccguuaggccgaanagaacau

SEQ ID NO: 15821 - RNA, 38 nt, Artificial Sequence
  Description of Artificial Sequence:  Enzymatic Nucleic Acid
  misc_feature (31)..(31): n stands for inosine
gucauuugcugaugaggccguuaggccgaancuauuag

SEQ ID NO: 15822 - RNA, 38 nt, Artificial Sequence
  Description of Artificial Sequence:  Enzymatic Nucleic Acid
  misc_feature (31)..(31): n stands for inosine
augucauucugaugaggccguuaggccgaanugcuauu

SEQ ID NO: 15823 - RNA, 38 nt, Artificial Sequence
  Description of Artificial Sequence:  Enzymatic Nucleic Acid
  misc_feature (31)..(31): n stands for inosine
gaucaaaacugaugaggccguuaggccgaanucauuug

SEQ ID NO: 15824 - RNA, 38 nt, Artificial Sequence
  Description of Artificial Sequence:  Enzymatic Nucleic Acid
  misc_feature (31)..(31): n stands for inosine
aagcuccacugaugaggccguuaggccgaanaucaaaa

SEQ ID NO: 15825 - RNA, 38 nt, Artificial Sequence
  Description of Artificial Sequence:  Enzymatic Nucleic Acid
  misc_feature (31)..(31): n stands for inosine
cauucuuacugaugaggccguuaggccgaancuccaug

SEQ ID NO: 15826 - RNA, 38 nt, Artificial Sequence
  Description of Artificial Sequence:  Enzymatic Nucleic Acid
  misc_feature (31)..(31): n stands for inosine
ugcaaggacugaugaggccguuaggccgaancauucuu

SEQ ID NO: 15827 - RNA, 38 nt, Artificial Sequence
  Description of Artificial Sequence:  Enzymatic Nucleic Acid
  misc_feature (31)..(31): n stands for inosine
uccugcaacugaugaggccguuaggccgaanaugcauu

SEQ ID NO: 15828 - RNA, 38 nt, Artificial Sequence
  Description of Artificial Sequence:  Enzymatic Nucleic Acid
  misc_feature (31)..(31): n stands for inosine
guccugcacugaugaggccguuaggccgaangaugcau

SEQ ID NO: 15829 - RNA, 38 nt, Artificial Sequence
  Description of Artificial Sequence:  Enzymatic Nucleic Acid
  misc_feature (31)..(31): n stands for inosine
cuuggucccugaugaggccguuaggccgaancaaggau

SEQ ID NO: 15830 - RNA, 38 nt, Artificial Sequence
  Description of Artificial Sequence:  Enzymatic Nucleic Acid
  misc_feature (31)..(31): n stands for inosine
gucuccuucugaugaggccguuaggccgaanuccugca

SEQ ID NO: 15831 - RNA, 38 nt, Artificial Sequence
  Description of Artificial Sequence:  Enzymatic Nucleic Acid
  misc_feature (31)..(31): n stands for inosine
agucuccucugaugaggccguuaggccgaanguccugc

SEQ ID NO: 15832 - RNA, 38 nt, Artificial Sequence
  Description of Artificial Sequence:  Enzymatic Nucleic Acid
  misc_feature (31)..(31): n stands for inosine
gcagacaucugaugaggccguuaggccgaanucuccuu

SEQ ID NO: 15833 - RNA, 38 nt, Artificial Sequence
  Description of Artificial Sequence:  Enzymatic Nucleic Acid
  misc_feature (31)..(31): n stands for inosine
agcaaggccugaugaggccguuaggccgaanacauagu

SEQ ID NO: 15834 - RNA, 38 nt, Artificial Sequence
  Description of Artificial Sequence:  Enzymatic Nucleic Acid
  misc_feature (31)..(31): n stands for inosine
uugagcaacugaugaggccguuaggccgaancagacau

SEQ ID NO: 15835 - RNA, 38 nt, Artificial Sequence
  Description of Artificial Sequence:  Enzymatic Nucleic Acid
  misc_feature (31)..(31): n stands for inosine
cuugagcacugaugaggccguuaggccgaangcagaca

SEQ ID NO: 15836 - RNA, 38 nt, Artificial Sequence
  Description of Artificial Sequence:  Enzymatic Nucleic Acid
  misc_feature (31)..(31): n stands for inosine
cugucuugcugaugaggccguuaggccgaancaaggca

SEQ ID NO: 15837 - RNA, 38 nt, Artificial Sequence
  Description of Artificial Sequence:  Enzymatic Nucleic Acid
  misc_feature (31)..(31): n stands for inosine
uccugucucugaugaggccguuaggccgaanagcaagg

SEQ ID NO: 15838 - RNA, 38 nt, Artificial Sequence
  Description of Artificial Sequence:  Enzymatic Nucleic Acid
  misc_feature (31)..(31): n stands for inosine
ggucuucccugaugaggccguuaggccgaanucuugag

SEQ ID NO: 15839 - RNA, 38 nt, Artificial Sequence
  Description of Artificial Sequence:  Enzymatic Nucleic Acid
  misc_feature (31)..(31): n stands for inosine
cuuuucuucugaugaggccguuaggccgaanucuuccu

SEQ ID NO: 15840 - RNA, 38 nt, Artificial Sequence
  Description of Artificial Sequence:  Enzymatic Nucleic Acid
  misc_feature (31)..(31): n stands for inosine
ucuuuucucugaugaggccguuaggccgaangucuucc

SEQ ID NO: 15841 - RNA, 38 nt, Artificial Sequence
  Description of Artificial Sequence:  Enzymatic Nucleic Acid
  misc_feature (31)..(31): n stands for inosine
ccacgcaacugaugaggccguuaggccgaanucuuuuc

SEQ ID NO: 15842 - RNA, 38 nt, Artificial Sequence
  Description of Artificial Sequence:  Enzymatic Nucleic Acid
  misc_feature (31)..(31): n stands for inosine
gagcugcccugaugaggccguuaggccgaanaccacgc

SEQ ID NO: 15843 - RNA, 38 nt, Artificial Sequence
  Description of Artificial Sequence:  Enzymatic Nucleic Acid
  misc_feature (31)..(31): n stands for inosine
cugugagccugaugaggccguuaggccgaanccugacc

SEQ ID NO: 15844 - RNA, 38 nt, Artificial Sequence
  Description of Artificial Sequence:  Enzymatic Nucleic Acid
  misc_feature (31)..(31): n stands for inosine
ggacugugcugaugaggccguuaggccgaancugccug

SEQ ID NO: 15845 - RNA, 38 nt, Artificial Sequence
  Description of Artificial Sequence:  Enzymatic Nucleic Acid
  misc_feature (31)..(31): n stands for inosine
uaggacugcugaugaggccguuaggccgaanagcugcc

SEQ ID NO: 15846 - RNA, 38 nt, Artificial Sequence
  Description of Artificial Sequence:  Enzymatic Nucleic Acid
  misc_feature (31)..(31): n stands for inosine
ucuaggaccugaugaggccguuaggccgaanugagcug

SEQ ID NO: 15847 - RNA, 38 nt, Artificial Sequence
  Description of Artificial Sequence:  Enzymatic Nucleic Acid
  misc_feature (31)..(31): n stands for inosine
acgcucuacugaugaggccguuaggccgaanacuguga

SEQ ID NO: 15848 - RNA, 38 nt, Artificial Sequence
  Description of Artificial Sequence:  Enzymatic Nucleic Acid
  misc_feature (31)..(31): n stands for inosine
cacgcucucugaugaggccguuaggccgaangacugug

SEQ ID NO: 15849 - RNA, 38 nt, Artificial Sequence
  Description of Artificial Sequence:  Enzymatic Nucleic Acid
  misc_feature (31)..(31): n stands for inosine
aucgugggcugaugaggccguuaggccgaanccacacg

SEQ ID NO: 15850 - RNA, 38 nt, Artificial Sequence
  Description of Artificial Sequence:  Enzymatic Nucleic Acid
  misc_feature (31)..(31): n stands for inosine
ugaucgugcugaugaggccguuaggccgaanugccaca

SEQ ID NO: 15851 - RNA, 38 nt, Artificial Sequence
  Description of Artificial Sequence:  Enzymatic Nucleic Acid
  misc_feature (31)..(31): n stands for inosine
gugaucgucugaugaggccguuaggccgaangugccac

SEQ ID NO: 15852 - RNA, 38 nt, Artificial Sequence
  Description of Artificial Sequence:  Enzymatic Nucleic Acid
  misc_feature (31)..(31): n stands for inosine
ugugaucgcugaugaggccguuaggccgaanggugcca

SEQ ID NO: 15853 - RNA, 38 nt, Artificial Sequence
  Description of Artificial Sequence:  Enzymatic Nucleic Acid
  misc_feature (31)..(31): n stands for inosine
guuuccugcugaugaggccguuaggccgaanaucgugg

SEQ ID NO: 15854 - RNA, 38 nt, Artificial Sequence
  Description of Artificial Sequence:  Enzymatic Nucleic Acid
  misc_feature (31)..(31): n stands for inosine
agguuucccugaugaggccguuaggccgaanugaucgu

SEQ ID NO: 15855 - RNA, 38 nt, Artificial Sequence
  Description of Artificial Sequence:  Enzymatic Nucleic Acid
  misc_feature (31)..(31): n stands for inosine
auucuccacugaugaggccguuaggccgaanuuuccug

SEQ ID NO: 15856 - RNA, 38 nt, Artificial Sequence
  Description of Artificial Sequence:  Enzymatic Nucleic Acid
  misc_feature (31)..(31): n stands for inosine
gauucucccugaugaggccguuaggccgaanguuuccu

SEQ ID NO: 15857 - RNA, 38 nt, Artificial Sequence
  Description of Artificial Sequence:  Enzymatic Nucleic Acid
  misc_feature (31)..(31): n stands for inosine
uugucguccugaugaggccguuaggccgaanauucucc

SEQ ID NO: 15858 - RNA, 38 nt, Artificial Sequence
  Description of Artificial Sequence:  Enzymatic Nucleic Acid
  misc_feature (31)..(31): n stands for inosine
ccaauacucugaugaggccguuaggccgaanucgucug

SEQ ID NO: 15859 - RNA, 38 nt, Artificial Sequence
  Description of Artificial Sequence:  Enzymatic Nucleic Acid
  misc_feature (31)..(31): n stands for inosine
gacuucgacugaugaggccguuaggccgaancuuuccc

SEQ ID NO: 15860 - RNA, 38 nt, Artificial Sequence
  Description of Artificial Sequence:  Enzymatic Nucleic Acid
  misc_feature (31)..(31): n stands for inosine
cgugcaugcugaugaggccguuaggccgaanacuucga

SEQ ID NO: 15861 - RNA, 38 nt, Artificial Sequence
  Description of Artificial Sequence:  Enzymatic Nucleic Acid
  misc_feature (31)..(31): n stands for inosine
gccgugcacugaugaggccguuaggccgaanagacuuc

SEQ ID NO: 15862 - RNA, 38 nt, Artificial Sequence
  Description of Artificial Sequence:  Enzymatic Nucleic Acid
  misc_feature (31)..(31): n stands for inosine
agaugccgcugaugaggccguuaggccgaancaugaga

SEQ ID NO: 15863 - RNA, 38 nt, Artificial Sequence
  Description of Artificial Sequence:  Enzymatic Nucleic Acid
  misc_feature (31)..(31): n stands for inosine
uucccagacugaugaggccguuaggccgaanccgugca

SEQ ID NO: 15864 - RNA, 38 nt, Artificial Sequence
  Description of Artificial Sequence:  Enzymatic Nucleic Acid
  misc_feature (31)..(31): n stands for inosine
ggauuccccugaugaggccguuaggccgaanaugccgu

SEQ ID NO: 15865 - RNA, 38 nt, Artificial Sequence
  Description of Artificial Sequence:  Enzymatic Nucleic Acid
  misc_feature (31)..(31): n stands for inosine
guggagggcugaugaggccguuaggccgaanauuccca

SEQ ID NO: 15866 - RNA, 38 nt, Artificial Sequence
  Description of Artificial Sequence:  Enzymatic Nucleic Acid
  misc_feature (31)..(31): n stands for inosine
uguggaggcugaugaggccguuaggccgaangauuccc

SEQ ID NO: 15867 - RNA, 38 nt, Artificial Sequence
  Description of Artificial Sequence:  Enzymatic Nucleic Acid
  misc_feature (31)..(31): n stands for inosine
cuguggagcugaugaggccguuaggccgaanggauucc

SEQ ID NO: 15868 - RNA, 38 nt, Artificial Sequence
  Description of Artificial Sequence:  Enzymatic Nucleic Acid
  misc_feature (31)..(31): n stands for inosine
ucuguggacugaugaggccguuaggccgaangggauuc

SEQ ID NO: 15869 - RNA, 38 nt, Artificial Sequence
  Description of Artificial Sequence:  Enzymatic Nucleic Acid
  misc_feature (31)..(31): n stands for inosine
aucuguggcugaugaggccguuaggccgaanggggauu

SEQ ID NO: 15870 - RNA, 38 nt, Artificial Sequence
  Description of Artificial Sequence:  Enzymatic Nucleic Acid
  misc_feature (31)..(31): n stands for inosine
ugaucugucugaugaggccguuaggccgaanaggggga

SEQ ID NO: 15871 - RNA, 38 nt, Artificial Sequence
  Description of Artificial Sequence:  Enzymatic Nucleic Acid
  misc_feature (31)..(31): n stands for inosine
augaucugcugaugaggccguuaggccgaangaggggg

SEQ ID NO: 15872 - RNA, 38 nt, Artificial Sequence
  Description of Artificial Sequence:  Enzymatic Nucleic Acid
  misc_feature (31)..(31): n stands for inosine
acaugauccugaugaggccguuaggccgaanuggaggg

SEQ ID NO: 15873 - RNA, 38 nt, Artificial Sequence
  Description of Artificial Sequence:  Enzymatic Nucleic Acid
  misc_feature (31)..(31): n stands for inosine
aaaccacacugaugaggccguuaggccgaanaucugug

SEQ ID NO: 15874 - RNA, 38 nt, Artificial Sequence
  Description of Artificial Sequence:  Enzymatic Nucleic Acid
  misc_feature (31)..(31): n stands for inosine
ucuacaagcugaugaggccguuaggccgaanucucauu

SEQ ID NO: 15875 - RNA, 38 nt, Artificial Sequence
  Description of Artificial Sequence:  Enzymatic Nucleic Acid
  misc_feature (31)..(31): n stands for inosine
uucuacaacugaugaggccguuaggccgaangucucau

SEQ ID NO: 15876 - RNA, 38 nt, Artificial Sequence
  Description of Artificial Sequence:  Enzymatic Nucleic Acid
  misc_feature (31)..(31): n stands for inosine
cuucuacacugaugaggccguuaggccgaanggucuca

SEQ ID NO: 15877 - RNA, 38 nt, Artificial Sequence
  Description of Artificial Sequence:  Enzymatic Nucleic Acid
  misc_feature (31)..(31): n stands for inosine
aaugccugcugaugaggccguuaggccgaanucuucua

SEQ ID NO: 15878 - RNA, 38 nt, Artificial Sequence
  Description of Artificial Sequence:  Enzymatic Nucleic Acid
  misc_feature (31)..(31): n stands for inosine
acaaugcccugaugaggccguuaggccgaanagucuuc

SEQ ID NO: 15879 - RNA, 38 nt, Artificial Sequence
  Description of Artificial Sequence:  Enzymatic Nucleic Acid
  misc_feature (31)..(31): n stands for inosine
caauacaacugaugaggccguuaggccgaanccugagu

SEQ ID NO: 15880 - RNA, 38 nt, Artificial Sequence
  Description of Artificial Sequence:  Enzymatic Nucleic Acid
  misc_feature (31)..(31): n stands for inosine
gagguucccugaugaggccguuaggccgaanuucccau

SEQ ID NO: 15881 - RNA, 38 nt, Artificial Sequence
  Description of Artificial Sequence:  Enzymatic Nucleic Acid
  misc_feature (31)..(31): n stands for inosine
gauagugacugaugaggccguuaggccgaanuuccggu

SEQ ID NO: 15882 - RNA, 38 nt, Artificial Sequence
  Description of Artificial Sequence:  Enzymatic Nucleic Acid
  misc_feature (31)..(31): n stands for inosine
ggauagugcugaugaggccguuaggccgaanguuccgg

SEQ ID NO: 15883 - RNA, 38 nt, Artificial Sequence
  Description of Artificial Sequence:  Enzymatic Nucleic Acid
  misc_feature (31)..(31): n stands for inosine
gcggauagcugaugaggccguuaggccgaanagguucc

SEQ ID NO: 15884 - RNA, 38 nt, Artificial Sequence
  Description of Artificial Sequence:  Enzymatic Nucleic Acid
  misc_feature (31)..(31): n stands for inosine
cugcggaucugaugaggccguuaggccgaanugagguu

SEQ ID NO: 15885 - RNA, 38 nt, Artificial Sequence
  Description of Artificial Sequence:  Enzymatic Nucleic Acid
  misc_feature (31)..(31): n stands for inosine
cacucugccugaugaggccguuaggccgaanauaguga

SEQ ID NO: 15886 - RNA, 38 nt, Artificial Sequence
  Description of Artificial Sequence:  Enzymatic Nucleic Acid
  misc_feature (31)..(31): n stands for inosine
ccucacuccugaugaggccguuaggccgaancggauag

SEQ ID NO: 15887 - RNA, 38 nt, Artificial Sequence
  Description of Artificial Sequence:  Enzymatic Nucleic Acid
  misc_feature (31)..(31): n stands for inosine
gguguagacugaugaggccguuaggccgaanccuucgu

SEQ ID NO: 15888 - RNA, 38 nt, Artificial Sequence
  Description of Artificial Sequence:  Enzymatic Nucleic Acid
  misc_feature (31)..(31): n stands for inosine
agguguagcugaugaggccguuaggccgaangccuucg

SEQ ID NO: 15889 - RNA, 38 nt, Artificial Sequence
  Description of Artificial Sequence:  Enzymatic Nucleic Acid
  misc_feature (31)..(31): n stands for inosine
gcaggugucugaugaggccguuaggccgaanaggccuu

SEQ ID NO: 15890 - RNA, 38 nt, Artificial Sequence
  Description of Artificial Sequence:  Enzymatic Nucleic Acid
  misc_feature (31)..(31): n stands for inosine
cuggcaggcugaugaggccguuaggccgaanuagaggc

SEQ ID NO: 15891 - RNA, 38 nt, Artificial Sequence
  Description of Artificial Sequence:  Enzymatic Nucleic Acid
  misc_feature (31)..(31): n stands for inosine
gccuggcacugaugaggccguuaggccgaanuguagag

SEQ ID NO: 15892 - RNA, 38 nt, Artificial Sequence
  Description of Artificial Sequence:  Enzymatic Nucleic Acid
  misc_feature (31)..(31): n stands for inosine
ugccuggccugaugaggccguuaggccgaanguguaga

SEQ ID NO: 15893 - RNA, 38 nt, Artificial Sequence
  Description of Artificial Sequence:  Enzymatic Nucleic Acid
  misc_feature (31)..(31): n stands for inosine
gcaugccucugaugaggccguuaggccgaancaggugu

SEQ ID NO: 15894 - RNA, 38 nt, Artificial Sequence
  Description of Artificial Sequence:  Enzymatic Nucleic Acid
  misc_feature (31)..(31): n stands for inosine
ugcaugcccugaugaggccguuaggccgaangcaggug

SEQ ID NO: 15895 - RNA, 38 nt, Artificial Sequence
  Description of Artificial Sequence:  Enzymatic Nucleic Acid
  misc_feature (31)..(31): n stands for inosine
acacugcacugaugaggccguuaggccgaanccuggca

SEQ ID NO: 15896 - RNA, 38 nt, Artificial Sequence
  Description of Artificial Sequence:  Enzymatic Nucleic Acid
  misc_feature (31)..(31): n stands for inosine
aagaacaccugaugaggccguuaggccgaancaugccu

SEQ ID NO: 15897 - RNA, 38 nt, Artificial Sequence
  Description of Artificial Sequence:  Enzymatic Nucleic Acid
  misc_feature (31)..(31): n stands for inosine
cacagccacugaugaggccguuaggccgaanaacacug

SEQ ID NO: 15898 - RNA, 38 nt, Artificial Sequence
  Description of Artificial Sequence:  Enzymatic Nucleic Acid
  misc_feature (31)..(31): n stands for inosine
uuuugcaccugaugaggccguuaggccgaanccaagaa

SEQ ID NO: 15899 - RNA, 38 nt, Artificial Sequence
  Description of Artificial Sequence:  Enzymatic Nucleic Acid
  misc_feature (31)..(31): n stands for inosine
uccacuuucugaugaggccguuaggccgaancacagcc

SEQ ID NO: 15900 - RNA, 38 nt, Artificial Sequence
  Description of Artificial Sequence:  Enzymatic Nucleic Acid
  misc_feature (31)..(31): n stands for inosine
augaaaaacugaugaggccguuaggccgaanccuccac

SEQ ID NO: 15901 - RNA, 38 nt, Artificial Sequence
  Description of Artificial Sequence:  Enzymatic Nucleic Acid
  misc_feature (31)..(31): n stands for inosine
uucuauuacugaugaggccguuaggccgaanaaaaaug

SEQ ID NO: 15902 - RNA, 38 nt, Artificial Sequence
  Description of Artificial Sequence:  Enzymatic Nucleic Acid
  misc_feature (31)..(31): n stands for inosine
uuuuccugcugaugaggccguuaggccgaancaccuuc

SEQ ID NO: 15903 - RNA, 38 nt, Artificial Sequence
  Description of Artificial Sequence:  Enzymatic Nucleic Acid
  misc_feature (31)..(31): n stands for inosine
cuuuuccucugaugaggccguuaggccgaangcaccuu

SEQ ID NO: 15904 - RNA, 38 nt, Artificial Sequence
  Description of Artificial Sequence:  Enzymatic Nucleic Acid
  misc_feature (31)..(31): n stands for inosine
ucuuuucccugaugaggccguuaggccgaanggcaccu

SEQ ID NO: 15905 - RNA, 38 nt, Artificial Sequence
  Description of Artificial Sequence:  Enzymatic Nucleic Acid
  misc_feature (31)..(31): n stands for inosine
gauuuccacugaugaggccguuaggccgaanuucgucu

SEQ ID NO: 15906 - RNA, 38 nt, Artificial Sequence
  Description of Artificial Sequence:  Enzymatic Nucleic Acid
  misc_feature (31)..(31): n stands for inosine
uagaauaacugaugaggccguuaggccgaanauuucca

SEQ ID NO: 15907 - RNA, 38 nt, Artificial Sequence
  Description of Artificial Sequence:  Enzymatic Nucleic Acid
  misc_feature (31)..(31): n stands for inosine
ugccuacucugaugaggccguuaggccgaanaauaaug

SEQ ID NO: 15908 - RNA, 38 nt, Artificial Sequence
  Description of Artificial Sequence:  Enzymatic Nucleic Acid
  misc_feature (31)..(31): n stands for inosine
caccgucgcugaugaggccguuaggccgaanccuacua

SEQ ID NO: 15909 - RNA, 38 nt, Artificial Sequence
  Description of Artificial Sequence:  Enzymatic Nucleic Acid
  misc_feature (31)..(31): n stands for inosine
aagaacaucugaugaggccguuaggccgaancaaucac

SEQ ID NO: 15910 - RNA, 38 nt, Artificial Sequence
  Description of Artificial Sequence:  Enzymatic Nucleic Acid
  misc_feature (31)..(31): n stands for inosine
gaagaacacugaugaggccguuaggccgaangcaauca

SEQ ID NO: 15911 - RNA, 38 nt, Artificial Sequence
  Description of Artificial Sequence:  Enzymatic Nucleic Acid
  misc_feature (31)..(31): n stands for inosine
uagccagacugaugaggccguuaggccgaanaacaugg

SEQ ID NO: 15912 - RNA, 38 nt, Artificial Sequence
  Description of Artificial Sequence:  Enzymatic Nucleic Acid
  misc_feature (31)..(31): n stands for inosine
aaguagcccugaugaggccguuaggccgaanaagaaca

SEQ ID NO: 15913 - RNA, 38 nt, Artificial Sequence
  Description of Artificial Sequence:  Enzymatic Nucleic Acid
  misc_feature (31)..(31): n stands for inosine
caagaagucugaugaggccguuaggccgaanccagaag

SEQ ID NO: 15914 - RNA, 38 nt, Artificial Sequence
  Description of Artificial Sequence:  Enzymatic Nucleic Acid
  misc_feature (31)..(31): n stands for inosine
ugacaagacugaugaggccguuaggccgaanuagccag

SEQ ID NO: 15915 - RNA, 38 nt, Artificial Sequence
  Description of Artificial Sequence:  Enzymatic Nucleic Acid
  misc_feature (31)..(31): n stands for inosine
ugaugacacugaugaggccguuaggccgaanaaguagc

SEQ ID NO: 15916 - RNA, 38 nt, Artificial Sequence
  Description of Artificial Sequence:  Enzymatic Nucleic Acid
  misc_feature (31)..(31): n stands for inosine
uaggaugacugaugaggccguuaggccgaanacaagaa

SEQ ID NO: 15917 - RNA, 38 nt, Artificial Sequence
  Description of Artificial Sequence:  Enzymatic Nucleic Acid
  misc_feature (31)..(31): n stands for inosine
cccuaggacugaugaggccguuaggccgaanaugacaa

SEQ ID NO: 15918 - RNA, 38 nt, Artificial Sequence
  Description of Artificial Sequence:  Enzymatic Nucleic Acid
  misc_feature (31)..(31): n stands for inosine
ggucccuacugaugaggccguuaggccgaanaugauga

SEQ ID NO: 15919 - RNA, 38 nt, Artificial Sequence
  Description of Artificial Sequence:  Enzymatic Nucleic Acid
  misc_feature (31)..(31): n stands for inosine
cggucccucugaugaggccguuaggccgaangaugaug

SEQ ID NO: 15920 - RNA, 38 nt, Artificial Sequence
  Description of Artificial Sequence:  Enzymatic Nucleic Acid
  misc_feature (31)..(31): n stands for inosine
cgcuuaaccugaugaggccguuaggccgaanucccuag

SEQ ID NO: 15921 - RNA, 38 nt, Artificial Sequence
  Description of Artificial Sequence:  Enzymatic Nucleic Acid
  misc_feature (31)..(31): n stands for inosine
ccuccauucugaugaggccguuaggccgaancccgcuu

SEQ ID NO: 15922 - RNA, 38 nt, Artificial Sequence
  Description of Artificial Sequence:  Enzymatic Nucleic Acid
  misc_feature (31)..(31): n stands for inosine
cccuccaucugaugaggccguuaggccgaangcccgcu

SEQ ID NO: 15923 - RNA, 38 nt, Artificial Sequence
  Description of Artificial Sequence:  Enzymatic Nucleic Acid
  misc_feature (31)..(31): n stands for inosine
cugucuuccugaugaggccguuaggccgaanuuccccu

SEQ ID NO: 15924 - RNA, 38 nt, Artificial Sequence
  Description of Artificial Sequence:  Enzymatic Nucleic Acid
  misc_feature (31)..(31): n stands for inosine
aaguagcccugaugaggccguuaggccgaanucuucag

SEQ ID NO: 15925 - RNA, 38 nt, Artificial Sequence
  Description of Artificial Sequence:  Enzymatic Nucleic Acid
  misc_feature (31)..(31): n stands for inosine
ggacaagucugaugaggccguuaggccgaanccugucu

SEQ ID NO: 15926 - RNA, 38 nt, Artificial Sequence
  Description of Artificial Sequence:  Enzymatic Nucleic Acid
  misc_feature (31)..(31): n stands for inosine
gauggacacugaugaggccguuaggccgaanuagccug

SEQ ID NO: 15927 - RNA, 38 nt, Artificial Sequence
  Description of Artificial Sequence:  Enzymatic Nucleic Acid
  misc_feature (31)..(31): n stands for inosine
augacgaucugaugaggccguuaggccgaanacaagua

SEQ ID NO: 15928 - RNA, 38 nt, Artificial Sequence
  Description of Artificial Sequence:  Enzymatic Nucleic Acid
  misc_feature (31)..(31): n stands for inosine
caugacgacugaugaggccguuaggccgaangacaagu

SEQ ID NO: 15929 - RNA, 38 nt, Artificial Sequence
  Description of Artificial Sequence:  Enzymatic Nucleic Acid
  misc_feature (31)..(31): n stands for inosine
uggauccacugaugaggccguuaggccgaanacgaugg

SEQ ID NO: 15930 - RNA, 38 nt, Artificial Sequence
  Description of Artificial Sequence:  Enzymatic Nucleic Acid
  misc_feature (31)..(31): n stands for inosine
guucaucucugaugaggccguuaggccgaanauccaug

SEQ ID NO: 15931 - RNA, 38 nt, Artificial Sequence
  Description of Artificial Sequence:  Enzymatic Nucleic Acid
  misc_feature (31)..(31): n stands for inosine
aguucauccugaugaggccguuaggccgaangauccau

SEQ ID NO: 15932 - RNA, 38 nt, Artificial Sequence
  Description of Artificial Sequence:  Enzymatic Nucleic Acid
  misc_feature (31)..(31): n stands for inosine
ccaaugggcugaugaggccguuaggccgaanuucaucu

SEQ ID NO: 15933 - RNA, 38 nt, Artificial Sequence
  Description of Artificial Sequence:  Enzymatic Nucleic Acid
  misc_feature (31)..(31): n stands for inosine
auccaaugcugaugaggccguuaggccgaanaguucau

SEQ ID NO: 15934 - RNA, 38 nt, Artificial Sequence
  Description of Artificial Sequence:  Enzymatic Nucleic Acid
  misc_feature (31)..(31): n stands for inosine
cauccaaucugaugaggccguuaggccgaangaguuca

SEQ ID NO: 15935 - RNA, 38 nt, Artificial Sequence
  Description of Artificial Sequence:  Enzymatic Nucleic Acid
  misc_feature (31)..(31): n stands for inosine
ucauccaacugaugaggccguuaggccgaanggaguuc

SEQ ID NO: 15936 - RNA, 38 nt, Artificial Sequence
  Description of Artificial Sequence:  Enzymatic Nucleic Acid
  misc_feature (31)..(31): n stands for inosine
guucacaacugaugaggccguuaggccgaanuucaucc

SEQ ID NO: 15937 - RNA, 38 nt, Artificial Sequence
  Description of Artificial Sequence:  Enzymatic Nucleic Acid
  misc_feature (31)..(31): n stands for inosine
cauaaggccugaugaggccguuaggccgaanucguuca

SEQ ID NO: 15938 - RNA, 38 nt, Artificial Sequence
  Description of Artificial Sequence:  Enzymatic Nucleic Acid
  misc_feature (31)..(31): n stands for inosine
caucauaacugaugaggccguuaggccgaancagucgu

SEQ ID NO: 15939 - RNA, 38 nt, Artificial Sequence
  Description of Artificial Sequence:  Enzymatic Nucleic Acid
  misc_feature (31)..(31): n stands for inosine
gcaucauacugaugaggccguuaggccgaangcagucg

SEQ ID NO: 15940 - RNA, 38 nt, Artificial Sequence
  Description of Artificial Sequence:  Enzymatic Nucleic Acid
  misc_feature (31)..(31): n stands for inosine
cauuugcucugaugaggccguuaggccgaancaucaua

SEQ ID NO: 15941 - RNA, 38 nt, Artificial Sequence
  Description of Artificial Sequence:  Enzymatic Nucleic Acid
  misc_feature (31)..(31): n stands for inosine
ccauuugccugaugaggccguuaggccgaangcaucau

SEQ ID NO: 15942 - RNA, 38 nt, Artificial Sequence
  Description of Artificial Sequence:  Enzymatic Nucleic Acid
  misc_feature (31)..(31): n stands for inosine
uucccauucugaugaggccguuaggccgaancuggcau

SEQ ID NO: 15943 - RNA, 38 nt, Artificial Sequence
  Description of Artificial Sequence:  Enzymatic Nucleic Acid
  misc_feature (31)..(31): n stands for inosine
gucucuggcugaugaggccguuaggccgaanaauuccc

SEQ ID NO: 15944 - RNA, 38 nt, Artificial Sequence
  Description of Artificial Sequence:  Enzymatic Nucleic Acid
  misc_feature (31)..(31): n stands for inosine
ggucucugcugaugaggccguuaggccgaangaauucc

SEQ ID NO: 15945 - RNA, 38 nt, Artificial Sequence
  Description of Artificial Sequence:  Enzymatic Nucleic Acid
  misc_feature (31)..(31): n stands for inosine
cggucucucugaugaggccguuaggccgaanggaauuc

SEQ ID NO: 15946 - RNA, 38 nt, Artificial Sequence
  Description of Artificial Sequence:  Enzymatic Nucleic Acid
  misc_feature (31)..(31): n stands for inosine
ccggucuccugaugaggccguuaggccgaangggaauu

SEQ ID NO: 15947 - RNA, 38 nt, Artificial Sequence
  Description of Artificial Sequence:  Enzymatic Nucleic Acid
  misc_feature (31)..(31): n stands for inosine
guucagcccugaugaggccguuaggccgaanucucugg

SEQ ID NO: 15948 - RNA, 38 nt, Artificial Sequence
  Description of Artificial Sequence:  Enzymatic Nucleic Acid
  misc_feature (31)..(31): n stands for inosine
cuagguuccugaugaggccguuaggccgaanccggucu

SEQ ID NO: 15949 - RNA, 38 nt, Artificial Sequence
  Description of Artificial Sequence:  Enzymatic Nucleic Acid
  misc_feature (31)..(31): n stands for inosine
cuuaccuacugaugaggccguuaggccgaanuucagcc

SEQ ID NO: 15950 - RNA, 38 nt, Artificial Sequence
  Description of Artificial Sequence:  Enzymatic Nucleic Acid
  misc_feature (31)..(31): n stands for inosine
gcuuaccucugaugaggccguuaggccgaanguucagc

SEQ ID NO: 15951 - RNA, 38 nt, Artificial Sequence
  Description of Artificial Sequence:  Enzymatic Nucleic Acid
  misc_feature (31)..(31): n stands for inosine
ggccaagacugaugaggccguuaggccgaancuuaccu

SEQ ID NO: 15952 - RNA, 38 nt, Artificial Sequence
  Description of Artificial Sequence:  Enzymatic Nucleic Acid
  misc_feature (31)..(31): n stands for inosine
cggccaagcugaugaggccguuaggccgaangcuuacc

SEQ ID NO: 15953 - RNA, 38 nt, Artificial Sequence
  Description of Artificial Sequence:  Enzymatic Nucleic Acid
  misc_feature (31)..(31): n stands for inosine
cacggccacugaugaggccguuaggccgaanaggcuua

SEQ ID NO: 15954 - RNA, 38 nt, Artificial Sequence
  Description of Artificial Sequence:  Enzymatic Nucleic Acid
  misc_feature (31)..(31): n stands for inosine
ggcaccaccugaugaggccguuaggccgaanccaagag

SEQ ID NO: 15955 - RNA, 38 nt, Artificial Sequence
  Description of Artificial Sequence:  Enzymatic Nucleic Acid
  misc_feature (31)..(31): n stands for inosine
uggccaaacugaugaggccguuaggccgaancaccacg

SEQ ID NO: 15956 - RNA, 38 nt, Artificial Sequence
  Description of Artificial Sequence:  Enzymatic Nucleic Acid
  misc_feature (31)..(31): n stands for inosine
uuggccaacugaugaggccguuaggccgaangcaccac

SEQ ID NO: 15957 - RNA, 38 nt, Artificial Sequence
  Description of Artificial Sequence:  Enzymatic Nucleic Acid
  misc_feature (31)..(31): n stands for inosine
aaucucuucugaugaggccguuaggccgaanccaaagg

SEQ ID NO: 15958 - RNA, 38 nt, Artificial Sequence
  Description of Artificial Sequence:  Enzymatic Nucleic Acid
  misc_feature (31)..(31): n stands for inosine
caaucucucugaugaggccguuaggccgaangccaaag

SEQ ID NO: 15959 - RNA, 38 nt, Artificial Sequence
  Description of Artificial Sequence:  Enzymatic Nucleic Acid
  misc_feature (31)..(31): n stands for inosine
aaggcauccugaugaggccguuaggccgaancuucaau

SEQ ID NO: 15960 - RNA, 38 nt, Artificial Sequence
  Description of Artificial Sequence:  Enzymatic Nucleic Acid
  misc_feature (31)..(31): n stands for inosine
auuccaaacugaugaggccguuaggccgaancaucugc

SEQ ID NO: 15961 - RNA, 38 nt, Artificial Sequence
  Description of Artificial Sequence:  Enzymatic Nucleic Acid
  misc_feature (31)..(31): n stands for inosine
aauuccaacugaugaggccguuaggccgaangcaucug

SEQ ID NO: 15962 - RNA, 38 nt, Artificial Sequence
  Description of Artificial Sequence:  Enzymatic Nucleic Acid
  misc_feature (31)..(31): n stands for inosine
ugcugucucugaugaggccguuaggccgaanucaauuc

SEQ ID NO: 15963 - RNA, 38 nt, Artificial Sequence
  Description of Artificial Sequence:  Enzymatic Nucleic Acid
  misc_feature (31)..(31): n stands for inosine
caaguugccugaugaggccguuaggccgaanucuuguc

SEQ ID NO: 15964 - RNA, 38 nt, Artificial Sequence
  Description of Artificial Sequence:  Enzymatic Nucleic Acid
  misc_feature (31)..(31): n stands for inosine
cugcaagucugaugaggccguuaggccgaancugucuu

SEQ ID NO: 15965 - RNA, 38 nt, Artificial Sequence
  Description of Artificial Sequence:  Enzymatic Nucleic Acid
  misc_feature (31)..(31): n stands for inosine
guccugcacugaugaggccguuaggccgaanuugcugu

SEQ ID NO: 15966 - RNA, 38 nt, Artificial Sequence
  Description of Artificial Sequence:  Enzymatic Nucleic Acid
  misc_feature (31)..(31): n stands for inosine
uacugucccugaugaggccguuaggccgaancaaguug

SEQ ID NO: 15967 - RNA, 38 nt, Artificial Sequence
  Description of Artificial Sequence:  Enzymatic Nucleic Acid
  misc_feature (31)..(31): n stands for inosine
acugcuaccugaugaggccguuaggccgaanuccugca

SEQ ID NO: 15968 - RNA, 38 nt, Artificial Sequence
  Description of Artificial Sequence:  Enzymatic Nucleic Acid
  misc_feature (31)..(31): n stands for inosine
auuuugaccugaugaggccguuaggccgaancuacugu

SEQ ID NO: 15969 - RNA, 38 nt, Artificial Sequence
  Description of Artificial Sequence:  Enzymatic Nucleic Acid
  misc_feature (31)..(31): n stands for inosine
caacauuucugaugaggccguuaggccgaanacugcua

SEQ ID NO: 15970 - RNA, 38 nt, Artificial Sequence
  Description of Artificial Sequence:  Enzymatic Nucleic Acid
  misc_feature (31)..(31): n stands for inosine
cugugugucugaugaggccguuaggccgaancuccuuc

SEQ ID NO: 15971 - RNA, 38 nt, Artificial Sequence
  Description of Artificial Sequence:  Enzymatic Nucleic Acid
  misc_feature (31)..(31): n stands for inosine
ucacugugcugaugaggccguuaggccgaanuugcucc

SEQ ID NO: 15972 - RNA, 38 nt, Artificial Sequence
  Description of Artificial Sequence:  Enzymatic Nucleic Acid
  misc_feature (31)..(31): n stands for inosine
gcucacugcugaugaggccguuaggccgaanuguugcu

SEQ ID NO: 15973 - RNA, 38 nt, Artificial Sequence
  Description of Artificial Sequence:  Enzymatic Nucleic Acid
  misc_feature (31)..(31): n stands for inosine
augcucaccugaugaggccguuaggccgaanuguguug

SEQ ID NO: 15974 - RNA, 38 nt, Artificial Sequence
  Description of Artificial Sequence:  Enzymatic Nucleic Acid
  misc_feature (31)..(31): n stands for inosine
gagcucgacugaugaggccguuaggccgaancucacug

SEQ ID NO: 15975 - RNA, 38 nt, Artificial Sequence
  Description of Artificial Sequence:  Enzymatic Nucleic Acid
  misc_feature (31)..(31): n stands for inosine
gacaugagcugaugaggccguuaggccgaancucgaug

SEQ ID NO: 15976 - RNA, 38 nt, Artificial Sequence
  Description of Artificial Sequence:  Enzymatic Nucleic Acid
  misc_feature (31)..(31): n stands for inosine
cagacaugcugaugaggccguuaggccgaanagcucga

SEQ ID NO: 15977 - RNA, 38 nt, Artificial Sequence
  Description of Artificial Sequence:  Enzymatic Nucleic Acid
  misc_feature (31)..(31): n stands for inosine
uucagacacugaugaggccguuaggccgaanagagcuc

SEQ ID NO: 15978 - RNA, 38 nt, Artificial Sequence
  Description of Artificial Sequence:  Enzymatic Nucleic Acid
  misc_feature (31)..(31): n stands for inosine
uugaguuccugaugaggccguuaggccgaanacaugag

SEQ ID NO: 15979 - RNA, 38 nt, Artificial Sequence
  Description of Artificial Sequence:  Enzymatic Nucleic Acid
  misc_feature (31)..(31): n stands for inosine
ggaucuugcugaugaggccguuaggccgaanuucagac

SEQ ID NO: 15980 - RNA, 38 nt, Artificial Sequence
  Description of Artificial Sequence:  Enzymatic Nucleic Acid
  misc_feature (31)..(31): n stands for inosine
gaggaucucugaugaggccguuaggccgaanaguucag

SEQ ID NO: 15981 - RNA, 38 nt, Artificial Sequence
  Description of Artificial Sequence:  Enzymatic Nucleic Acid
  misc_feature (31)..(31): n stands for inosine
augaaugacugaugaggccguuaggccgaanaucuuga

SEQ ID NO: 15982 - RNA, 38 nt, Artificial Sequence
  Description of Artificial Sequence:  Enzymatic Nucleic Acid
  misc_feature (31)..(31): n stands for inosine
uaugaaugcugaugaggccguuaggccgaangaucuug

SEQ ID NO: 15983 - RNA, 38 nt, Artificial Sequence
  Description of Artificial Sequence:  Enzymatic Nucleic Acid
  misc_feature (31)..(31): n stands for inosine
aauaugaacugaugaggccguuaggccgaanaggaucu

SEQ ID NO: 15984 - RNA, 38 nt, Artificial Sequence
  Description of Artificial Sequence:  Enzymatic Nucleic Acid
  misc_feature (31)..(31): n stands for inosine
gaccaauacugaugaggccguuaggccgaanaaugagg

SEQ ID NO: 15985 - RNA, 38 nt, Artificial Sequence
  Description of Artificial Sequence:  Enzymatic Nucleic Acid
  misc_feature (31)..(31): n stands for inosine
ugagauggcugaugaggccguuaggccgaanaccaaua

SEQ ID NO: 15986 - RNA, 38 nt, Artificial Sequence
  Description of Artificial Sequence:  Enzymatic Nucleic Acid
  misc_feature (31)..(31): n stands for inosine
auugagaucugaugaggccguuaggccgaanugaccaa

SEQ ID NO: 15987 - RNA, 38 nt, Artificial Sequence
  Description of Artificial Sequence:  Enzymatic Nucleic Acid
  misc_feature (31)..(31): n stands for inosine
cauugagacugaugaggccguuaggccgaangugacca

SEQ ID NO: 15988 - RNA, 38 nt, Artificial Sequence
  Description of Artificial Sequence:  Enzymatic Nucleic Acid
  misc_feature (31)..(31): n stands for inosine
ccacauugcugaugaggccguuaggccgaanaugguga

SEQ ID NO: 15989 - RNA, 38 nt, Artificial Sequence
  Description of Artificial Sequence:  Enzymatic Nucleic Acid
  misc_feature (31)..(31): n stands for inosine
gaccacaucugaugaggccguuaggccgaanagauggu

SEQ ID NO: 15990 - RNA, 38 nt, Artificial Sequence
  Description of Artificial Sequence:  Enzymatic Nucleic Acid
  misc_feature (31)..(31): n stands for inosine
uagaaggucugaugaggccguuaggccgaanaccacau

SEQ ID NO: 15991 - RNA, 38 nt, Artificial Sequence
  Description of Artificial Sequence:  Enzymatic Nucleic Acid
  misc_feature (31)..(31): n stands for inosine
accuagaacugaugaggccguuaggccgaanuugacca

SEQ ID NO: 15992 - RNA, 38 nt, Artificial Sequence
  Description of Artificial Sequence:  Enzymatic Nucleic Acid
  misc_feature (31)..(31): n stands for inosine
caccuagacugaugaggccguuaggccgaanguugacc

SEQ ID NO: 15993 - RNA, 38 nt, Artificial Sequence
  Description of Artificial Sequence:  Enzymatic Nucleic Acid
  misc_feature (31)..(31): n stands for inosine
aggcaccucugaugaggccguuaggccgaanaagguug

SEQ ID NO: 15994 - RNA, 38 nt, Artificial Sequence
  Description of Artificial Sequence:  Enzymatic Nucleic Acid
  misc_feature (31)..(31): n stands for inosine
uugguacacugaugaggccguuaggccgaancaccuag

SEQ ID NO: 15995 - RNA, 38 nt, Artificial Sequence
  Description of Artificial Sequence:  Enzymatic Nucleic Acid
  misc_feature (31)..(31): n stands for inosine
cuugguaccugaugaggccguuaggccgaangcaccua

SEQ ID NO: 15996 - RNA, 38 nt, Artificial Sequence
  Description of Artificial Sequence:  Enzymatic Nucleic Acid
  misc_feature (31)..(31): n stands for inosine
ccuggcuucugaugaggccguuaggccgaanuacaggc

SEQ ID NO: 15997 - RNA, 38 nt, Artificial Sequence
  Description of Artificial Sequence:  Enzymatic Nucleic Acid
  misc_feature (31)..(31): n stands for inosine
uccuggcucugaugaggccguuaggccgaanguacagg

SEQ ID NO: 15998 - RNA, 38 nt, Artificial Sequence
  Description of Artificial Sequence:  Enzymatic Nucleic Acid
  misc_feature (31)..(31): n stands for inosine
gcccuccucugaugaggccguuaggccgaancuuggua

SEQ ID NO: 15999 - RNA, 38 nt, Artificial Sequence
  Description of Artificial Sequence:  Enzymatic Nucleic Acid
  misc_feature (31)..(31): n stands for inosine
ggcccucccugaugaggccguuaggccgaangcuuggu

SEQ ID NO: 16000 - RNA, 38 nt, Artificial Sequence
  Description of Artificial Sequence:  Enzymatic Nucleic Acid
  misc_feature (31)..(31): n stands for inosine
ccaugagucugaugaggccguuaggccgaancccuccu

SEQ ID NO: 16001 - RNA, 38 nt, Artificial Sequence
  Description of Artificial Sequence:  Enzymatic Nucleic Acid
  misc_feature (31)..(31): n stands for inosine
accaugagcugaugaggccguuaggccgaangcccucc

SEQ ID NO: 16002 - RNA, 38 nt, Artificial Sequence
  Description of Artificial Sequence:  Enzymatic Nucleic Acid
  misc_feature (31)..(31): n stands for inosine
ucaccaugcugaugaggccguuaggccgaanuggcccu

SEQ ID NO: 16003 - RNA, 38 nt, Artificial Sequence
  Description of Artificial Sequence:  Enzymatic Nucleic Acid
  misc_feature (31)..(31): n stands for inosine
aaucaccacugaugaggccguuaggccgaanaguggcc

SEQ ID NO: 16004 - RNA, 38 nt, Artificial Sequence
  Description of Artificial Sequence:  Enzymatic Nucleic Acid
  misc_feature (31)..(31): n stands for inosine
aaauuugccugaugaggccguuaggccgaanaauucca

SEQ ID NO: 16005 - RNA, 38 nt, Artificial Sequence
  Description of Artificial Sequence:  Enzymatic Nucleic Acid
  misc_feature (31)..(31): n stands for inosine
uccaaauucugaugaggccguuaggccgaancagaauu

SEQ ID NO: 16006 - RNA, 38 nt, Artificial Sequence
  Description of Artificial Sequence:  Enzymatic Nucleic Acid
  misc_feature (31)..(31): n stands for inosine
aguggacacugaugaggccguuaggccgaanuuuccaa

SEQ ID NO: 16007 - RNA, 38 nt, Artificial Sequence
  Description of Artificial Sequence:  Enzymatic Nucleic Acid
  misc_feature (31)..(31): n stands for inosine
aaguggaccugaugaggccguuaggccgaanguuucca

SEQ ID NO: 16008 - RNA, 38 nt, Artificial Sequence
  Description of Artificial Sequence:  Enzymatic Nucleic Acid
  misc_feature (31)..(31): n stands for inosine
agguaagucugaugaggccguuaggccgaanacagguu

SEQ ID NO: 16009 - RNA, 38 nt, Artificial Sequence
  Description of Artificial Sequence:  Enzymatic Nucleic Acid
  misc_feature (31)..(31): n stands for inosine
cagguaagcugaugaggccguuaggccgaangacaggu

SEQ ID NO: 16010 - RNA, 38 nt, Artificial Sequence
  Description of Artificial Sequence:  Enzymatic Nucleic Acid
  misc_feature (31)..(31): n stands for inosine
cucagguacugaugaggccguuaggccgaanuggacag

SEQ ID NO: 16011 - RNA, 38 nt, Artificial Sequence
  Description of Artificial Sequence:  Enzymatic Nucleic Acid
  misc_feature (31)..(31): n stands for inosine
gcuccucacugaugaggccguuaggccgaanuaagugg

SEQ ID NO: 16012 - RNA, 38 nt, Artificial Sequence
  Description of Artificial Sequence:  Enzymatic Nucleic Acid
  misc_feature (31)..(31): n stands for inosine
ugcuccuccugaugaggccguuaggccgaanguaagug

SEQ ID NO: 16013 - RNA, 38 nt, Artificial Sequence
  Description of Artificial Sequence:  Enzymatic Nucleic Acid
  misc_feature (31)..(31): n stands for inosine
auuucucucugaugaggccguuaggccgaancuccuca

SEQ ID NO: 16014 - RNA, 38 nt, Artificial Sequence
  Description of Artificial Sequence:  Enzymatic Nucleic Acid
  misc_feature (31)..(31): n stands for inosine
cuuguaggcugaugaggccguuaggccgaanacaaauu

SEQ ID NO: 16015 - RNA, 38 nt, Artificial Sequence
  Description of Artificial Sequence:  Enzymatic Nucleic Acid
  misc_feature (31)..(31): n stands for inosine
ucuuguagcugaugaggccguuaggccgaangacaaau

SEQ ID NO: 16016 - RNA, 38 nt, Artificial Sequence
  Description of Artificial Sequence:  Enzymatic Nucleic Acid
  misc_feature (31)..(31): n stands for inosine
gucuuguacugaugaggccguuaggccgaanggacaaa

SEQ ID NO: 16017 - RNA, 38 nt, Artificial Sequence
  Description of Artificial Sequence:  Enzymatic Nucleic Acid
  misc_feature (31)..(31): n stands for inosine
ggucuugucugaugaggccguuaggccgaangggacaa

SEQ ID NO: 16018 - RNA, 38 nt, Artificial Sequence
  Description of Artificial Sequence:  Enzymatic Nucleic Acid
  misc_feature (31)..(31): n stands for inosine
uuuggucucugaugaggccguuaggccgaanuagggga

SEQ ID NO: 16019 - RNA, 38 nt, Artificial Sequence
  Description of Artificial Sequence:  Enzymatic Nucleic Acid
  misc_feature (31)..(31): n stands for inosine
gccccuuucugaugaggccguuaggccgaanucuugua

SEQ ID NO: 16020 - RNA, 38 nt, Artificial Sequence
  Description of Artificial Sequence:  Enzymatic Nucleic Acid
  misc_feature (31)..(31): n stands for inosine
ugccccuucugaugaggccguuaggccgaangucuugu

SEQ ID NO: 16021 - RNA, 38 nt, Artificial Sequence
  Description of Artificial Sequence:  Enzymatic Nucleic Acid
  misc_feature (31)..(31): n stands for inosine
cggaaucgcugaugaggccguuaggccgaanccccuuu

SEQ ID NO: 16022 - RNA, 38 nt, Artificial Sequence
  Description of Artificial Sequence:  Enzymatic Nucleic Acid
  misc_feature (31)..(31): n stands for inosine
cccuugaccugaugaggccguuaggccgaanaaucgug

SEQ ID NO: 16023 - RNA, 38 nt, Artificial Sequence
  Description of Artificial Sequence:  Enzymatic Nucleic Acid
  misc_feature (31)..(31): n stands for inosine
cuuucccucugaugaggccguuaggccgaanacggaau

SEQ ID NO: 16024 - RNA, 38 nt, Artificial Sequence
  Description of Artificial Sequence:  Enzymatic Nucleic Acid
  misc_feature (31)..(31): n stands for inosine
uccaacgucugaugaggccguuaggccgaanucuuucc

SEQ ID NO: 16025 - RNA, 38 nt, Artificial Sequence
  Description of Artificial Sequence:  Enzymatic Nucleic Acid
  misc_feature (31)..(31): n stands for inosine
acagggaucugaugaggccguuaggccgaancuccaac

SEQ ID NO: 16026 - RNA, 38 nt, Artificial Sequence
  Description of Artificial Sequence:  Enzymatic Nucleic Acid
  misc_feature (31)..(31): n stands for inosine
auccacagcugaugaggccguuaggccgaanauugcuc

SEQ ID NO: 16027 - RNA, 38 nt, Artificial Sequence
  Description of Artificial Sequence:  Enzymatic Nucleic Acid
  misc_feature (31)..(31): n stands for inosine
gauccacacugaugaggccguuaggccgaangauugcu

SEQ ID NO: 16028 - RNA, 38 nt, Artificial Sequence
  Description of Artificial Sequence:  Enzymatic Nucleic Acid
  misc_feature (31)..(31): n stands for inosine
agauccaccugaugaggccguuaggccgaanggauugc

SEQ ID NO: 16029 - RNA, 38 nt, Artificial Sequence
  Description of Artificial Sequence:  Enzymatic Nucleic Acid
  misc_feature (31)..(31): n stands for inosine
gccguuuccugaugaggccguuaggccgaanauccaca

SEQ ID NO: 16030 - RNA, 38 nt, Artificial Sequence
  Description of Artificial Sequence:  Enzymatic Nucleic Acid
  misc_feature (31)..(31): n stands for inosine
gcuguccacugaugaggccguuaggccgaancgccguu

SEQ ID NO: 16031 - RNA, 38 nt, Artificial Sequence
  Description of Artificial Sequence:  Enzymatic Nucleic Acid
  misc_feature (31)..(31): n stands for inosine
ggugaugccugaugaggccguuaggccgaanuccaagc

SEQ ID NO: 16032 - RNA, 38 nt, Artificial Sequence
  Description of Artificial Sequence:  Enzymatic Nucleic Acid
  misc_feature (31)..(31): n stands for inosine
acuggugacugaugaggccguuaggccgaancugucca

SEQ ID NO: 16033 - RNA, 38 nt, Artificial Sequence
  Description of Artificial Sequence:  Enzymatic Nucleic Acid
  misc_feature (31)..(31): n stands for inosine
gcuacuggcugaugaggccguuaggccgaanaugcugu

SEQ ID NO: 16034 - RNA, 38 nt, Artificial Sequence
  Description of Artificial Sequence:  Enzymatic Nucleic Acid
  misc_feature (31)..(31): n stands for inosine
uggcuacucugaugaggccguuaggccgaanugaugcu

SEQ ID NO: 16035 - RNA, 38 nt, Artificial Sequence
  Description of Artificial Sequence:  Enzymatic Nucleic Acid
  misc_feature (31)..(31): n stands for inosine
cuggcuaccugaugaggccguuaggccgaangugaugc

SEQ ID NO: 16036 - RNA, 38 nt, Artificial Sequence
  Description of Artificial Sequence:  Enzymatic Nucleic Acid
  misc_feature (31)..(31): n stands for inosine
ugagcucucugaugaggccguuaggccgaancuacugg

SEQ ID NO: 16037 - RNA, 38 nt, Artificial Sequence
  Description of Artificial Sequence:  Enzymatic Nucleic Acid
  misc_feature (31)..(31): n stands for inosine
cugagcuccugaugaggccguuaggccgaangcuacug

SEQ ID NO: 16038 - RNA, 38 nt, Artificial Sequence
  Description of Artificial Sequence:  Enzymatic Nucleic Acid
  misc_feature (31)..(31): n stands for inosine
gcuggcugcugaugaggccguuaggccgaancucuggc

SEQ ID NO: 16039 - RNA, 38 nt, Artificial Sequence
  Description of Artificial Sequence:  Enzymatic Nucleic Acid
  misc_feature (31)..(31): n stands for inosine
gagcuggccugaugaggccguuaggccgaanagcucug

SEQ ID NO: 16040 - RNA, 38 nt, Artificial Sequence
  Description of Artificial Sequence:  Enzymatic Nucleic Acid
  misc_feature (31)..(31): n stands for inosine
ccagagcucugaugaggccguuaggccgaancugagcu

SEQ ID NO: 16041 - RNA, 38 nt, Artificial Sequence
  Description of Artificial Sequence:  Enzymatic Nucleic Acid
  misc_feature (31)..(31): n stands for inosine
uccagagccugaugaggccguuaggccgaangcugagc

SEQ ID NO: 16042 - RNA, 38 nt, Artificial Sequence
  Description of Artificial Sequence:  Enzymatic Nucleic Acid
  misc_feature (31)..(31): n stands for inosine
aaauccagcugaugaggccguuaggccgaancuggcug

SEQ ID NO: 16043 - RNA, 38 nt, Artificial Sequence
  Description of Artificial Sequence:  Enzymatic Nucleic Acid
  misc_feature (31)..(31): n stands for inosine
acaaaucccugaugaggccguuaggccgaanagcuggc

SEQ ID NO: 16044 - RNA, 38 nt, Artificial Sequence
  Description of Artificial Sequence:  Enzymatic Nucleic Acid
  misc_feature (31)..(31): n stands for inosine
ucacugagcugaugaggccguuaggccgaanacuucuc

SEQ ID NO: 16045 - RNA, 38 nt, Artificial Sequence
  Description of Artificial Sequence:  Enzymatic Nucleic Acid
  misc_feature (31)..(31): n stands for inosine
aucacugacugaugaggccguuaggccgaangacuucu

SEQ ID NO: 16046 - RNA, 38 nt, Artificial Sequence
  Description of Artificial Sequence:  Enzymatic Nucleic Acid
  misc_feature (31)..(31): n stands for inosine
caucacugcugaugaggccguuaggccgaanggacuuc

SEQ ID NO: 16047 - RNA, 38 nt, Artificial Sequence
  Description of Artificial Sequence:  Enzymatic Nucleic Acid
  misc_feature (31)..(31): n stands for inosine
uacaucaccugaugaggccguuaggccgaanagggacu

SEQ ID NO: 16048 - RNA, 38 nt, Artificial Sequence
  Description of Artificial Sequence:  Enzymatic Nucleic Acid
  misc_feature (31)..(31): n stands for inosine
ucuucaggcugaugaggccguuaggccgaancuuccuc

SEQ ID NO: 16049 - RNA, 38 nt, Artificial Sequence
  Description of Artificial Sequence:  Enzymatic Nucleic Acid
  misc_feature (31)..(31): n stands for inosine
gaucuucacugaugaggccguuaggccgaanagcuucc

SEQ ID NO: 16050 - RNA, 38 nt, Artificial Sequence
  Description of Artificial Sequence:  Enzymatic Nucleic Acid
  misc_feature (31)..(31): n stands for inosine
agaucuuccugaugaggccguuaggccgaangagcuuc

SEQ ID NO: 16051 - RNA, 38 nt, Artificial Sequence
  Description of Artificial Sequence:  Enzymatic Nucleic Acid
  misc_feature (31)..(31): n stands for inosine
ccuuauaccugaugaggccguuaggccgaanaucuuca

SEQ ID NO: 16052 - RNA, 38 nt, Artificial Sequence
  Description of Artificial Sequence:  Enzymatic Nucleic Acid
  misc_feature (31)..(31): n stands for inosine
ggucaggacugaugaggccguuaggccgaanuccuuau

SEQ ID NO: 16053 - RNA, 38 nt, Artificial Sequence
  Description of Artificial Sequence:  Enzymatic Nucleic Acid
  misc_feature (31)..(31): n stands for inosine
caaggucacugaugaggccguuaggccgaanaaguccu

SEQ ID NO: 16054 - RNA, 38 nt, Artificial Sequence
  Description of Artificial Sequence:  Enzymatic Nucleic Acid
  misc_feature (31)..(31): n stands for inosine
ccaagguccugaugaggccguuaggccgaangaagucc

SEQ ID NO: 16055 - RNA, 38 nt, Artificial Sequence
  Description of Artificial Sequence:  Enzymatic Nucleic Acid
  misc_feature (31)..(31): n stands for inosine
ugcuccaacugaugaggccguuaggccgaanucaggaa

SEQ ID NO: 16056 - RNA, 38 nt, Artificial Sequence
  Description of Artificial Sequence:  Enzymatic Nucleic Acid
  misc_feature (31)..(31): n stands for inosine
augcuccacugaugaggccguuaggccgaangucagga

SEQ ID NO: 16057 - RNA, 38 nt, Artificial Sequence
  Description of Artificial Sequence:  Enzymatic Nucleic Acid
  misc_feature (31)..(31): n stands for inosine
agaugagacugaugaggccguuaggccgaancuccaag

SEQ ID NO: 16058 - RNA, 38 nt, Artificial Sequence
  Description of Artificial Sequence:  Enzymatic Nucleic Acid
  misc_feature (31)..(31): n stands for inosine
aacagaugcugaugaggccguuaggccgaanaugcucc

SEQ ID NO: 16059 - RNA, 38 nt, Artificial Sequence
  Description of Artificial Sequence:  Enzymatic Nucleic Acid
  misc_feature (31)..(31): n stands for inosine
guaacagacugaugaggccguuaggccgaanagaugcu

SEQ ID NO: 16060 - RNA, 38 nt, Artificial Sequence
  Description of Artificial Sequence:  Enzymatic Nucleic Acid
  misc_feature (31)..(31): n stands for inosine
gcuguaaccugaugaggccguuaggccgaanaugagau

SEQ ID NO: 16061 - RNA, 38 nt, Artificial Sequence
  Description of Artificial Sequence:  Enzymatic Nucleic Acid
  misc_feature (31)..(31): n stands for inosine
uuggaagccugaugaggccguuaggccgaanuaacaga

SEQ ID NO: 16062 - RNA, 38 nt, Artificial Sequence
  Description of Artificial Sequence:  Enzymatic Nucleic Acid
  misc_feature (31)..(31): n stands for inosine
cacuuggacugaugaggccguuaggccgaancuguaac

SEQ ID NO: 16063 - RNA, 38 nt, Artificial Sequence
  Description of Artificial Sequence:  Enzymatic Nucleic Acid
  misc_feature (31)..(31): n stands for inosine
agccacuucugaugaggccguuaggccgaanaagcugu

SEQ ID NO: 16064 - RNA, 38 nt, Artificial Sequence
  Description of Artificial Sequence:  Enzymatic Nucleic Acid
  misc_feature (31)..(31): n stands for inosine
uagccacucugaugaggccguuaggccgaangaagcug

SEQ ID NO: 16065 - RNA, 38 nt, Artificial Sequence
  Description of Artificial Sequence:  Enzymatic Nucleic Acid
  misc_feature (31)..(31): n stands for inosine
augcccuucugaugaggccguuaggccgaanccacuug

SEQ ID NO: 16066 - RNA, 38 nt, Artificial Sequence
  Description of Artificial Sequence:  Enzymatic Nucleic Acid
  misc_feature (31)..(31): n stands for inosine
gaacuccacugaugaggccguuaggccgaancccuuag

SEQ ID NO: 16067 - RNA, 38 nt, Artificial Sequence
  Description of Artificial Sequence:  Enzymatic Nucleic Acid
  misc_feature (31)..(31): n stands for inosine
cgaugccacugaugaggccguuaggccgaanaacucca

SEQ ID NO: 16068 - RNA, 38 nt, Artificial Sequence
  Description of Artificial Sequence:  Enzymatic Nucleic Acid
  misc_feature (31)..(31): n stands for inosine
uuucgcgacugaugaggccguuaggccgaanccaagaa

SEQ ID NO: 16069 - RNA, 38 nt, Artificial Sequence
  Description of Artificial Sequence:  Enzymatic Nucleic Acid
  misc_feature (31)..(31): n stands for inosine
gucccugucugaugaggccguuaggccgaanauacacu

SEQ ID NO: 16070 - RNA, 38 nt, Artificial Sequence
  Description of Artificial Sequence:  Enzymatic Nucleic Acid
  misc_feature (31)..(31): n stands for inosine
ggucccugcugaugaggccguuaggccgaangauacac

SEQ ID NO: 16071 - RNA, 38 nt, Artificial Sequence
  Description of Artificial Sequence:  Enzymatic Nucleic Acid
  misc_feature (31)..(31): n stands for inosine
cagguccccugaugaggccguuaggccgaanuggauac

SEQ ID NO: 16072 - RNA, 38 nt, Artificial Sequence
  Description of Artificial Sequence:  Enzymatic Nucleic Acid
  misc_feature (31)..(31): n stands for inosine
ugccgccacugaugaggccguuaggccgaanucccugu

SEQ ID NO: 16073 - RNA, 38 nt, Artificial Sequence
  Description of Artificial Sequence:  Enzymatic Nucleic Acid
  misc_feature (31)..(31): n stands for inosine
gugccgcccugaugaggccguuaggccgaangucccug

SEQ ID NO: 16074 - RNA, 38 nt, Artificial Sequence
  Description of Artificial Sequence:  Enzymatic Nucleic Acid
  misc_feature (31)..(31): n stands for inosine
auauuucgcugaugaggccguuaggccgaanccgccag

SEQ ID NO: 16075 - RNA, 38 nt, Artificial Sequence
  Description of Artificial Sequence:  Enzymatic Nucleic Acid
  misc_feature (31)..(31): n stands for inosine
cgauaagacugaugaggccguuaggccgaanauauuuc

SEQ ID NO: 16076 - RNA, 38 nt, Artificial Sequence
  Description of Artificial Sequence:  Enzymatic Nucleic Acid
  misc_feature (31)..(31): n stands for inosine
ccgauaagcugaugaggccguuaggccgaangauauuu

SEQ ID NO: 16077 - RNA, 38 nt, Artificial Sequence
  Description of Artificial Sequence:  Enzymatic Nucleic Acid
  misc_feature (31)..(31): n stands for inosine
cuccgauacugaugaggccguuaggccgaanaggauau

SEQ ID NO: 16078 - RNA, 38 nt, Artificial Sequence
  Description of Artificial Sequence:  Enzymatic Nucleic Acid
  misc_feature (31)..(31): n stands for inosine
aaagucaccugaugaggccguuaggccgaanauuuuaa

SEQ ID NO: 16079 - RNA, 38 nt, Artificial Sequence
  Description of Artificial Sequence:  Enzymatic Nucleic Acid
  misc_feature (31)..(31): n stands for inosine
caagccaacugaugaggccguuaggccgaanucacaga

SEQ ID NO: 16080 - RNA, 38 nt, Artificial Sequence
  Description of Artificial Sequence:  Enzymatic Nucleic Acid
  misc_feature (31)..(31): n stands for inosine
ccgggccacugaugaggccguuaggccgaanccaaagu

SEQ ID NO: 16081 - RNA, 38 nt, Artificial Sequence
  Description of Artificial Sequence:  Enzymatic Nucleic Acid
  misc_feature (31)..(31): n stands for inosine
auaucccgcugaugaggccguuaggccgaanccaagcc

SEQ ID NO: 16082 - RNA, 38 nt, Artificial Sequence
  Description of Artificial Sequence:  Enzymatic Nucleic Acid
  misc_feature (31)..(31): n stands for inosine
aauauccccugaugaggccguuaggccgaangccaagc

SEQ ID NO: 16083 - RNA, 38 nt, Artificial Sequence
  Description of Artificial Sequence:  Enzymatic Nucleic Acid
  misc_feature (31)..(31): n stands for inosine
cauaaucucugaugaggccguuaggccgaanaucuuua

SEQ ID NO: 16084 - RNA, 38 nt, Artificial Sequence
  Description of Artificial Sequence:  Enzymatic Nucleic Acid
  misc_feature (31)..(31): n stands for inosine
acauaauccugaugaggccguuaggccgaangaucuuu

SEQ ID NO: 16085 - RNA, 38 nt, Artificial Sequence
  Description of Artificial Sequence:  Enzymatic Nucleic Acid
  misc_feature (31)..(31): n stands for inosine
uccuuuuccugaugaggccguuaggccgaanacauaau

SEQ ID NO: 16086 - RNA, 38 nt, Artificial Sequence
  Description of Artificial Sequence:  Enzymatic Nucleic Acid
  misc_feature (31)..(31): n stands for inosine
gggaggcgcugaugaggccguuaggccgaancaucucc

SEQ ID NO: 16087 - RNA, 38 nt, Artificial Sequence
  Description of Artificial Sequence:  Enzymatic Nucleic Acid
  misc_feature (31)..(31): n stands for inosine
caaagggacugaugaggccguuaggccgaancgagcau

SEQ ID NO: 16088 - RNA, 38 nt, Artificial Sequence
  Description of Artificial Sequence:  Enzymatic Nucleic Acid
  misc_feature (31)..(31): n stands for inosine
ucaaagggcugaugaggccguuaggccgaangcgagca

SEQ ID NO: 16089 - RNA, 38 nt, Artificial Sequence
  Description of Artificial Sequence:  Enzymatic Nucleic Acid
  misc_feature (31)..(31): n stands for inosine
uuucaaagcugaugaggccguuaggccgaanaggcgag

SEQ ID NO: 16090 - RNA, 38 nt, Artificial Sequence
  Description of Artificial Sequence:  Enzymatic Nucleic Acid
  misc_feature (31)..(31): n stands for inosine
auuucaaacugaugaggccguuaggccgaangaggcga

SEQ ID NO: 16091 - RNA, 38 nt, Artificial Sequence
  Description of Artificial Sequence:  Enzymatic Nucleic Acid
  misc_feature (31)..(31): n stands for inosine
cauuucaacugaugaggccguuaggccgaanggaggcg

SEQ ID NO: 16092 - RNA, 38 nt, Artificial Sequence
  Description of Artificial Sequence:  Enzymatic Nucleic Acid
  misc_feature (31)..(31): n stands for inosine
guuucuggcugaugaggccguuaggccgaanccaucca

SEQ ID NO: 16093 - RNA, 38 nt, Artificial Sequence
  Description of Artificial Sequence:  Enzymatic Nucleic Acid
  misc_feature (31)..(31): n stands for inosine
uguuucugcugaugaggccguuaggccgaangccaucc

SEQ ID NO: 16094 - RNA, 38 nt, Artificial Sequence
  Description of Artificial Sequence:  Enzymatic Nucleic Acid
  misc_feature (31)..(31): n stands for inosine
uuguuucucugaugaggccguuaggccgaanggccauc

SEQ ID NO: 16095 - RNA, 38 nt, Artificial Sequence
  Description of Artificial Sequence:  Enzymatic Nucleic Acid
  misc_feature (31)..(31): n stands for inosine
auuguuuccugaugaggccguuaggccgaangggccau

SEQ ID NO: 16096 - RNA, 38 nt, Artificial Sequence
  Description of Artificial Sequence:  Enzymatic Nucleic Acid
  misc_feature (31)..(31): n stands for inosine
ucaaaaaucugaugaggccguuaggccgaanuuucugg

SEQ ID NO: 16097 - RNA, 38 nt, Artificial Sequence
  Description of Artificial Sequence:  Enzymatic Nucleic Acid
  misc_feature (31)..(31): n stands for inosine
guacacuccugaugaggccguuaggccgaanucaaaaa

SEQ ID NO: 16098 - RNA, 38 nt, Artificial Sequence
  Description of Artificial Sequence:  Enzymatic Nucleic Acid
  misc_feature (31)..(31): n stands for inosine
cuggauugcugaugaggccguuaggccgaanuacacuc

SEQ ID NO: 16099 - RNA, 38 nt, Artificial Sequence
  Description of Artificial Sequence:  Enzymatic Nucleic Acid
  misc_feature (31)..(31): n stands for inosine
cucuggaucugaugaggccguuaggccgaanuguacac

SEQ ID NO: 16100 - RNA, 38 nt, Artificial Sequence
  Description of Artificial Sequence:  Enzymatic Nucleic Acid
  misc_feature (31)..(31): n stands for inosine
gucacucucugaugaggccguuaggccgaanauugugu

SEQ ID NO: 16101 - RNA, 38 nt, Artificial Sequence
  Description of Artificial Sequence:  Enzymatic Nucleic Acid
  misc_feature (31)..(31): n stands for inosine
cgucacuccugaugaggccguuaggccgaangauugug

SEQ ID NO: 16102 - RNA, 38 nt, Artificial Sequence
  Description of Artificial Sequence:  Enzymatic Nucleic Acid
  misc_feature (31)..(31): n stands for inosine
aaaagacccugaugaggccguuaggccgaanacgucac

SEQ ID NO: 16103 - RNA, 38 nt, Artificial Sequence
  Description of Artificial Sequence:  Enzymatic Nucleic Acid
  misc_feature (31)..(31): n stands for inosine
acaccaaacugaugaggccguuaggccgaanaccagac

SEQ ID NO: 16104 - RNA, 38 nt, Artificial Sequence
  Description of Artificial Sequence:  Enzymatic Nucleic Acid
  misc_feature (31)..(31): n stands for inosine
uuucccaccugaugaggccguuaggccgaancaaaaca

SEQ ID NO: 16105 - RNA, 38 nt, Artificial Sequence
  Description of Artificial Sequence:  Enzymatic Nucleic Acid
  misc_feature (31)..(31): n stands for inosine
gcaccuaacugaugaggccguuaggccgaanaaaauau

SEQ ID NO: 16106 - RNA, 38 nt, Artificial Sequence
  Description of Artificial Sequence:  Enzymatic Nucleic Acid
  misc_feature (31)..(31): n stands for inosine
agcaccuacugaugaggccguuaggccgaangaaaaua

SEQ ID NO: 16107 - RNA, 38 nt, Artificial Sequence
  Description of Artificial Sequence:  Enzymatic Nucleic Acid
  misc_feature (31)..(31): n stands for inosine
uauggagacugaugaggccguuaggccgaancaccuaa

SEQ ID NO: 16108 - RNA, 38 nt, Artificial Sequence
  Description of Artificial Sequence:  Enzymatic Nucleic Acid
  misc_feature (31)..(31): n stands for inosine
ggauauggcugaugaggccguuaggccgaanaagcacc

SEQ ID NO: 16109 - RNA, 38 nt, Artificial Sequence
  Description of Artificial Sequence:  Enzymatic Nucleic Acid
  misc_feature (31)..(31): n stands for inosine
caggauaucugaugaggccguuaggccgaanagaagca

SEQ ID NO: 16110 - RNA, 38 nt, Artificial Sequence
  Description of Artificial Sequence:  Enzymatic Nucleic Acid
  misc_feature (31)..(31): n stands for inosine
ccaggauacugaugaggccguuaggccgaangagaagc

SEQ ID NO: 16111 - RNA, 38 nt, Artificial Sequence
  Description of Artificial Sequence:  Enzymatic Nucleic Acid
  misc_feature (31)..(31): n stands for inosine
uuaccccacugaugaggccguuaggccgaanauaugga

SEQ ID NO: 16112 - RNA, 38 nt, Artificial Sequence
  Description of Artificial Sequence:  Enzymatic Nucleic Acid
  misc_feature (31)..(31): n stands for inosine
uuuacccccugaugaggccguuaggccgaangauaugg

SEQ ID NO: 16113 - RNA, 38 nt, Artificial Sequence
  Description of Artificial Sequence:  Enzymatic Nucleic Acid
  misc_feature (31)..(31): n stands for inosine
cucauucucugaugaggccguuaggccgaanuuccuuc

SEQ ID NO: 16114 - RNA, 38 nt, Artificial Sequence
  Description of Artificial Sequence:  Enzymatic Nucleic Acid
  misc_feature (31)..(31): n stands for inosine
uaaucaggcugaugaggccguuaggccgaancccucau

SEQ ID NO: 16115 - RNA, 38 nt, Artificial Sequence
  Description of Artificial Sequence:  Enzymatic Nucleic Acid
  misc_feature (31)..(31): n stands for inosine
auaaucagcugaugaggccguuaggccgaangcccuca

SEQ ID NO: 16116 - RNA, 38 nt, Artificial Sequence
  Description of Artificial Sequence:  Enzymatic Nucleic Acid
  misc_feature (31)..(31): n stands for inosine
uauaaucacugaugaggccguuaggccgaanggcccuc

SEQ ID NO: 16117 - RNA, 38 nt, Artificial Sequence
  Description of Artificial Sequence:  Enzymatic Nucleic Acid
  misc_feature (31)..(31): n stands for inosine
guauaauccugaugaggccguuaggccgaangggcccu

SEQ ID NO: 16118 - RNA, 38 nt, Artificial Sequence
  Description of Artificial Sequence:  Enzymatic Nucleic Acid
  misc_feature (31)..(31): n stands for inosine
ucuggugucugaugaggccguuaggccgaanuauaauc

SEQ ID NO: 16119 - RNA, 38 nt, Artificial Sequence
  Description of Artificial Sequence:  Enzymatic Nucleic Acid
  misc_feature (31)..(31): n stands for inosine
auuucuggcugaugaggccguuaggccgaanuaguaua

SEQ ID NO: 16120 - RNA, 38 nt, Artificial Sequence
  Description of Artificial Sequence:  Enzymatic Nucleic Acid
  misc_feature (31)..(31): n stands for inosine
acauuucucugaugaggccguuaggccgaanuguagua

SEQ ID NO: 16121 - RNA, 38 nt, Artificial Sequence
  Description of Artificial Sequence:  Enzymatic Nucleic Acid
  misc_feature (31)..(31): n stands for inosine
uacauuuccugaugaggccguuaggccgaanguguagu

SEQ ID NO: 16122 - RNA, 38 nt, Artificial Sequence
  Description of Artificial Sequence:  Enzymatic Nucleic Acid
  misc_feature (31)..(31): n stands for inosine
cauggucucugaugaggccguuaggccgaanuacauuu

SEQ ID NO: 16123 - RNA, 38 nt, Artificial Sequence
  Description of Artificial Sequence:  Enzymatic Nucleic Acid
  misc_feature (31)..(31): n stands for inosine
gcaugguccugaugaggccguuaggccgaanguacauu

SEQ ID NO: 16124 - RNA, 38 nt, Artificial Sequence
  Description of Artificial Sequence:  Enzymatic Nucleic Acid
  misc_feature (31)..(31): n stands for inosine
uccagcaucugaugaggccguuaggccgaanucuggua

SEQ ID NO: 16125 - RNA, 38 nt, Artificial Sequence
  Description of Artificial Sequence:  Enzymatic Nucleic Acid
  misc_feature (31)..(31): n stands for inosine
guccagcacugaugaggccguuaggccgaangucuggu

SEQ ID NO: 16126 - RNA, 38 nt, Artificial Sequence
  Description of Artificial Sequence:  Enzymatic Nucleic Acid
  misc_feature (31)..(31): n stands for inosine
agcagucccugaugaggccguuaggccgaancaugguc

SEQ ID NO: 16127 - RNA, 38 nt, Artificial Sequence
  Description of Artificial Sequence:  Enzymatic Nucleic Acid
  misc_feature (31)..(31): n stands for inosine
cccgugcccugaugaggccguuaggccgaancagucca

SEQ ID NO: 16128 - RNA, 38 nt, Artificial Sequence
  Description of Artificial Sequence:  Enzymatic Nucleic Acid
  misc_feature (31)..(31): n stands for inosine
gcuccccgcugaugaggccguuaggccgaanccagcag

SEQ ID NO: 16129 - RNA, 38 nt, Artificial Sequence
  Description of Artificial Sequence:  Enzymatic Nucleic Acid
  misc_feature (31)..(31): n stands for inosine
ucugacugcugaugaggccguuaggccgaancuccccg

SEQ ID NO: 16130 - RNA, 38 nt, Artificial Sequence
  Description of Artificial Sequence:  Enzymatic Nucleic Acid
  misc_feature (31)..(31): n stands for inosine
cucugacucugaugaggccguuaggccgaangcucccc

SEQ ID NO: 16131 - RNA, 38 nt, Artificial Sequence
  Description of Artificial Sequence:  Enzymatic Nucleic Acid
  misc_feature (31)..(31): n stands for inosine
ucucugaccugaugaggccguuaggccgaanggcuccc

SEQ ID NO: 16132 - RNA, 38 nt, Artificial Sequence
  Description of Artificial Sequence:  Enzymatic Nucleic Acid
  misc_feature (31)..(31): n stands for inosine
ugggucuccugaugaggccguuaggccgaanacugggc

SEQ ID NO: 16133 - RNA, 38 nt, Artificial Sequence
  Description of Artificial Sequence:  Enzymatic Nucleic Acid
  misc_feature (31)..(31): n stands for inosine
aaaacgugcugaugaggccguuaggccgaanucucuga

SEQ ID NO: 16134 - RNA, 38 nt, Artificial Sequence
  Description of Artificial Sequence:  Enzymatic Nucleic Acid
  misc_feature (31)..(31): n stands for inosine
gaaaacgucugaugaggccguuaggccgaangucucug

SEQ ID NO: 16135 - RNA, 38 nt, Artificial Sequence
  Description of Artificial Sequence:  Enzymatic Nucleic Acid
  misc_feature (31)..(31): n stands for inosine
ugaaaacgcugaugaggccguuaggccgaanggucucu

SEQ ID NO: 16136 - RNA, 38 nt, Artificial Sequence
  Description of Artificial Sequence:  Enzymatic Nucleic Acid
  misc_feature (31)..(31): n stands for inosine
accaacuccugaugaggccguuaggccgaanaaaacgu

SEQ ID NO: 16137 - RNA, 38 nt, Artificial Sequence
  Description of Artificial Sequence:  Enzymatic Nucleic Acid
  misc_feature (31)..(31): n stands for inosine
uucccaaacugaugaggccguuaggccgaanuuccacc

SEQ ID NO: 16138 - RNA, 38 nt, Artificial Sequence
  Description of Artificial Sequence:  Enzymatic Nucleic Acid
  misc_feature (31)..(31): n stands for inosine
cuugcaagcugaugaggccguuaggccgaanauuuccc

SEQ ID NO: 16139 - RNA, 38 nt, Artificial Sequence
  Description of Artificial Sequence:  Enzymatic Nucleic Acid
  misc_feature (31)..(31): n stands for inosine
agcuugcacugaugaggccguuaggccgaanagauuuc

SEQ ID NO: 16140 - RNA, 38 nt, Artificial Sequence
  Description of Artificial Sequence:  Enzymatic Nucleic Acid
  misc_feature (31)..(31): n stands for inosine
cauuagcucugaugaggccguuaggccgaancaagaga

SEQ ID NO: 16141 - RNA, 38 nt, Artificial Sequence
  Description of Artificial Sequence:  Enzymatic Nucleic Acid
  misc_feature (31)..(31): n stands for inosine
ugagcauucugaugaggccguuaggccgaancuugcaa

SEQ ID NO: 16142 - RNA, 38 nt, Artificial Sequence
  Description of Artificial Sequence:  Enzymatic Nucleic Acid
  misc_feature (31)..(31): n stands for inosine
uccugcugcugaugaggccguuaggccgaancauuagc

SEQ ID NO: 16143 - RNA, 38 nt, Artificial Sequence
  Description of Artificial Sequence:  Enzymatic Nucleic Acid
  misc_feature (31)..(31): n stands for inosine
cauccugccugaugaggccguuaggccgaanagcauua

SEQ ID NO: 16144 - RNA, 38 nt, Artificial Sequence
  Description of Artificial Sequence:  Enzymatic Nucleic Acid
  misc_feature (31)..(31): n stands for inosine
ugccaucccugaugaggccguuaggccgaancugagca

SEQ ID NO: 16145 - RNA, 38 nt, Artificial Sequence
  Description of Artificial Sequence:  Enzymatic Nucleic Acid
  misc_feature (31)..(31): n stands for inosine
guagucuucugaugaggccguuaggccgaanccauccu

SEQ ID NO: 16146 - RNA, 38 nt, Artificial Sequence
  Description of Artificial Sequence:  Enzymatic Nucleic Acid
  misc_feature (31)..(31): n stands for inosine
aacaaugucugaugaggccguuaggccgaanucuuugc

SEQ ID NO: 16147 - RNA, 38 nt, Artificial Sequence
  Description of Artificial Sequence:  Enzymatic Nucleic Acid
  misc_feature (31)..(31): n stands for inosine
aagaacaacugaugaggccguuaggccgaanuagucuu

SEQ ID NO: 16148 - RNA, 38 nt, Artificial Sequence
  Description of Artificial Sequence:  Enzymatic Nucleic Acid
  misc_feature (31)..(31): n stands for inosine
auaucggacugaugaggccguuaggccgaanaacaaug

SEQ ID NO: 16149 - RNA, 38 nt, Artificial Sequence
  Description of Artificial Sequence:  Enzymatic Nucleic Acid
  misc_feature (31)..(31): n stands for inosine
cugauauccugaugaggccguuaggccgaanaagaaca

SEQ ID NO: 16150 - RNA, 38 nt, Artificial Sequence
  Description of Artificial Sequence:  Enzymatic Nucleic Acid
  misc_feature (31)..(31): n stands for inosine
aaagucuccugaugaggccguuaggccgaanauaucgg

SEQ ID NO: 16151 - RNA, 38 nt, Artificial Sequence
  Description of Artificial Sequence:  Enzymatic Nucleic Acid
  misc_feature (31)..(31): n stands for inosine
augcucaacugaugaggccguuaggccgaanucucuga

SEQ ID NO: 16152 - RNA, 38 nt, Artificial Sequence
  Description of Artificial Sequence:  Enzymatic Nucleic Acid
  misc_feature (31)..(31): n stands for inosine
cucuuccacugaugaggccguuaggccgaancucaaag

SEQ ID NO: 16153 - RNA, 38 nt, Artificial Sequence
  Description of Artificial Sequence:  Enzymatic Nucleic Acid
  misc_feature (31)..(31): n stands for inosine
gagagucccugaugaggccguuaggccgaanaauccuc

SEQ ID NO: 16154 - RNA, 38 nt, Artificial Sequence
  Description of Artificial Sequence:  Enzymatic Nucleic Acid
  misc_feature (31)..(31): n stands for inosine
gcagagagcugaugaggccguuaggccgaanuccagaa

SEQ ID NO: 16155 - RNA, 38 nt, Artificial Sequence
  Description of Artificial Sequence:  Enzymatic Nucleic Acid
  misc_feature (31)..(31): n stands for inosine
aggcagagcugaugaggccguuaggccgaanaguccag

SEQ ID NO: 16156 - RNA, 38 nt, Artificial Sequence
  Description of Artificial Sequence:  Enzymatic Nucleic Acid
  misc_feature (31)..(31): n stands for inosine
guaggcagcugaugaggccguuaggccgaanagagucc

SEQ ID NO: 16157 - RNA, 38 nt, Artificial Sequence
  Description of Artificial Sequence:  Enzymatic Nucleic Acid
  misc_feature (31)..(31): n stands for inosine
agguaggccugaugaggccguuaggccgaanagagagu

SEQ ID NO: 16158 - RNA, 38 nt, Artificial Sequence
  Description of Artificial Sequence:  Enzymatic Nucleic Acid
  misc_feature (31)..(31): n stands for inosine
gugagguacugaugaggccguuaggccgaancagagag

SEQ ID NO: 16159 - RNA, 38 nt, Artificial Sequence
  Description of Artificial Sequence:  Enzymatic Nucleic Acid
  misc_feature (31)..(31): n stands for inosine
ggugaggucugaugaggccguuaggccgaangcagaga

SEQ ID NO: 16160 - RNA, 38 nt, Artificial Sequence
  Description of Artificial Sequence:  Enzymatic Nucleic Acid
  misc_feature (31)..(31): n stands for inosine
acaggugacugaugaggccguuaggccgaanuaggcag

SEQ ID NO: 16161 - RNA, 38 nt, Artificial Sequence
  Description of Artificial Sequence:  Enzymatic Nucleic Acid
  misc_feature (31)..(31): n stands for inosine
aacaggugcugaugaggccguuaggccgaanguaggca

SEQ ID NO: 16162 - RNA, 38 nt, Artificial Sequence
  Description of Artificial Sequence:  Enzymatic Nucleic Acid
  misc_feature (31)..(31): n stands for inosine
gaaacaggcugaugaggccguuaggccgaanagguagg

SEQ ID NO: 16163 - RNA, 38 nt, Artificial Sequence
  Description of Artificial Sequence:  Enzymatic Nucleic Acid
  misc_feature (31)..(31): n stands for inosine
aggaaacacugaugaggccguuaggccgaanugaggua

SEQ ID NO: 16164 - RNA, 38 nt, Artificial Sequence
  Description of Artificial Sequence:  Enzymatic Nucleic Acid
  misc_feature (31)..(31): n stands for inosine
caggaaaccugaugaggccguuaggccgaangugaggu

SEQ ID NO: 16165 - RNA, 38 nt, Artificial Sequence
  Description of Artificial Sequence:  Enzymatic Nucleic Acid
  misc_feature (31)..(31): n stands for inosine
uccauacacugaugaggccguuaggccgaanaaacagg

SEQ ID NO: 16166 - RNA, 38 nt, Artificial Sequence
  Description of Artificial Sequence:  Enzymatic Nucleic Acid
  misc_feature (31)..(31): n stands for inosine
cuccauaccugaugaggccguuaggccgaangaaacag

SEQ ID NO: 16167 - RNA, 38 nt, Artificial Sequence
  Description of Artificial Sequence:  Enzymatic Nucleic Acid
  misc_feature (31)..(31): n stands for inosine
gaauuuggcugaugaggccguuaggccgaanucacaua

SEQ ID NO: 16168 - RNA, 38 nt, Artificial Sequence
  Description of Artificial Sequence:  Enzymatic Nucleic Acid
  misc_feature (31)..(31): n stands for inosine
ggaauuugcugaugaggccguuaggccgaangucacau

SEQ ID NO: 16169 - RNA, 38 nt, Artificial Sequence
  Description of Artificial Sequence:  Enzymatic Nucleic Acid
  misc_feature (31)..(31): n stands for inosine
uggaauuucugaugaggccguuaggccgaanggucaca

SEQ ID NO: 16170 - RNA, 38 nt, Artificial Sequence
  Description of Artificial Sequence:  Enzymatic Nucleic Acid
  misc_feature (31)..(31): n stands for inosine
auggaauucugaugaggccguuaggccgaangggucac

SEQ ID NO: 16171 - RNA, 38 nt, Artificial Sequence
  Description of Artificial Sequence:  Enzymatic Nucleic Acid
  misc_feature (31)..(31): n stands for inosine
gucauaaucugaugaggccguuaggccgaanaauuugg

SEQ ID NO: 16172 - RNA, 38 nt, Artificial Sequence
  Description of Artificial Sequence:  Enzymatic Nucleic Acid
  misc_feature (31)..(31): n stands for inosine
ugucauaacugaugaggccguuaggccgaangaauuug

SEQ ID NO: 16173 - RNA, 38 nt, Artificial Sequence
  Description of Artificial Sequence:  Enzymatic Nucleic Acid
  misc_feature (31)..(31): n stands for inosine
ugcugugucugaugaggccguuaggccgaanucauaau

SEQ ID NO: 16174 - RNA, 38 nt, Artificial Sequence
  Description of Artificial Sequence:  Enzymatic Nucleic Acid
  misc_feature (31)..(31): n stands for inosine
uccugcugcugaugaggccguuaggccgaanuugucau

SEQ ID NO: 16175 - RNA, 38 nt, Artificial Sequence
  Description of Artificial Sequence:  Enzymatic Nucleic Acid
  misc_feature (31)..(31): n stands for inosine
auuccugccugaugaggccguuaggccgaanuguuguc

SEQ ID NO: 16176 - RNA, 38 nt, Artificial Sequence
  Description of Artificial Sequence:  Enzymatic Nucleic Acid
  misc_feature (31)..(31): n stands for inosine
cugauucccugaugaggccguuaggccgaancuguguu

SEQ ID NO: 16177 - RNA, 38 nt, Artificial Sequence
  Description of Artificial Sequence:  Enzymatic Nucleic Acid
  misc_feature (31)..(31): n stands for inosine
auacugaccugaugaggccguuaggccgaanauuccug

SEQ ID NO: 16178 - RNA, 38 nt, Artificial Sequence
  Description of Artificial Sequence:  Enzymatic Nucleic Acid
  misc_feature (31)..(31): n stands for inosine
gcagauaccugaugaggccguuaggccgaanacugauu

SEQ ID NO: 16179 - RNA, 38 nt, Artificial Sequence
  Description of Artificial Sequence:  Enzymatic Nucleic Acid
  misc_feature (31)..(31): n stands for inosine
uguucugccugaugaggccguuaggccgaanauacuga

SEQ ID NO: 16180 - RNA, 38 nt, Artificial Sequence
  Description of Artificial Sequence:  Enzymatic Nucleic Acid
  misc_feature (31)..(31): n stands for inosine
uacuguuccugaugaggccguuaggccgaancagauac

SEQ ID NO: 16181 - RNA, 38 nt, Artificial Sequence
  Description of Artificial Sequence:  Enzymatic Nucleic Acid
  misc_feature (31)..(31): n stands for inosine
ucgcuuaccugaugaggccguuaggccgaanuucugca

SEQ ID NO: 16182 - RNA, 38 nt, Artificial Sequence
  Description of Artificial Sequence:  Enzymatic Nucleic Acid
  misc_feature (31)..(31): n stands for inosine
cacaggcccugaugaggccguuaggccgaancucuuuc

SEQ ID NO: 16183 - RNA, 38 nt, Artificial Sequence
  Description of Artificial Sequence:  Enzymatic Nucleic Acid
  misc_feature (31)..(31): n stands for inosine
cacucacacugaugaggccguuaggccgaanccggcuc

SEQ ID NO: 16184 - RNA, 38 nt, Artificial Sequence
  Description of Artificial Sequence:  Enzymatic Nucleic Acid
  misc_feature (31)..(31): n stands for inosine
acacucaccugaugaggccguuaggccgaangccggcu

SEQ ID NO: 16185 - RNA, 38 nt, Artificial Sequence
  Description of Artificial Sequence:  Enzymatic Nucleic Acid
  misc_feature (31)..(31): n stands for inosine
ucuucaaacugaugaggccguuaggccgaanuuuuuac

SEQ ID NO: 16186 - RNA, 38 nt, Artificial Sequence
  Description of Artificial Sequence:  Enzymatic Nucleic Acid
  misc_feature (31)..(31): n stands for inosine
uucuaacgcugaugaggccguuaggccgaanauaucuu

SEQ ID NO: 16187 - RNA, 38 nt, Artificial Sequence
  Description of Artificial Sequence:  Enzymatic Nucleic Acid
  misc_feature (31)..(31): n stands for inosine
cuucuaaccugaugaggccguuaggccgaangauaucu

SEQ ID NO: 16188 - RNA, 38 nt, Artificial Sequence
  Description of Artificial Sequence:  Enzymatic Nucleic Acid
  misc_feature (31)..(31): n stands for inosine
uuacuucucugaugaggccguuaggccgaanuucuucu

SEQ ID NO: 16189 - RNA, 38 nt, Artificial Sequence
  Description of Artificial Sequence:  Enzymatic Nucleic Acid
  misc_feature (31)..(31): n stands for inosine
uuuacuuccugaugaggccguuaggccgaanguucuuc

SEQ ID NO: 16190 - RNA, 38 nt, Artificial Sequence
  Description of Artificial Sequence:  Enzymatic Nucleic Acid
  misc_feature (31)..(31): n stands for inosine
gucaucugcugaugaggccguuaggccgaanauuacuu

SEQ ID NO: 16191 - RNA, 38 nt, Artificial Sequence
  Description of Artificial Sequence:  Enzymatic Nucleic Acid
  misc_feature (31)..(31): n stands for inosine
ugucaucucugaugaggccguuaggccgaangauuacu

SEQ ID NO: 16192 - RNA, 38 nt, Artificial Sequence
  Description of Artificial Sequence:  Enzymatic Nucleic Acid
  misc_feature (31)..(31): n stands for inosine
uugucauccugaugaggccguuaggccgaanggauuac

SEQ ID NO: 16193 - RNA, 38 nt, Artificial Sequence
  Description of Artificial Sequence:  Enzymatic Nucleic Acid
  misc_feature (31)..(31): n stands for inosine
cgucuggucugaugaggccguuaggccgaanucaucug

SEQ ID NO: 16194 - RNA, 38 nt, Artificial Sequence
  Description of Artificial Sequence:  Enzymatic Nucleic Acid
  misc_feature (31)..(31): n stands for inosine
guccgucucugaugaggccguuaggccgaanuugucau

SEQ ID NO: 16195 - RNA, 38 nt, Artificial Sequence
  Description of Artificial Sequence:  Enzymatic Nucleic Acid
  misc_feature (31)..(31): n stands for inosine
uguccguccugaugaggccguuaggccgaanguuguca

SEQ ID NO: 16196 - RNA, 38 nt, Artificial Sequence
  Description of Artificial Sequence:  Enzymatic Nucleic Acid
  misc_feature (31)..(31): n stands for inosine
cauaccaccugaugaggccguuaggccgaanuccgucu

SEQ ID NO: 16197 - RNA, 38 nt, Artificial Sequence
  Description of Artificial Sequence:  Enzymatic Nucleic Acid
  misc_feature (31)..(31): n stands for inosine
cugaggcacugaugaggccguuaggccgaanaaccaua

SEQ ID NO: 16198 - RNA, 38 nt, Artificial Sequence
  Description of Artificial Sequence:  Enzymatic Nucleic Acid
  misc_feature (31)..(31): n stands for inosine
ucuucugacugaugaggccguuaggccgaancaagaac

SEQ ID NO: 16199 - RNA, 38 nt, Artificial Sequence
  Description of Artificial Sequence:  Enzymatic Nucleic Acid
  misc_feature (31)..(31): n stands for inosine
cucuucugcugaugaggccguuaggccgaangcaagaa

SEQ ID NO: 16200 - RNA, 38 nt, Artificial Sequence
  Description of Artificial Sequence:  Enzymatic Nucleic Acid
  misc_feature (31)..(31): n stands for inosine
agcucuuccugaugaggccguuaggccgaanaggcaag

SEQ ID NO: 16201 - RNA, 38 nt, Artificial Sequence
  Description of Artificial Sequence:  Enzymatic Nucleic Acid
  misc_feature (31)..(31): n stands for inosine
aaguuuuccugaugaggccguuaggccgaancucuucu

SEQ ID NO: 16202 - RNA, 38 nt, Artificial Sequence
  Description of Artificial Sequence:  Enzymatic Nucleic Acid
  misc_feature (31)..(31): n stands for inosine
ucuuccaacugaugaggccguuaggccgaanuuuucag

SEQ ID NO: 16203 - RNA, 38 nt, Artificial Sequence
  Description of Artificial Sequence:  Enzymatic Nucleic Acid
  misc_feature (31)..(31): n stands for inosine
uuugguuccugaugaggccguuaggccgaanucuucca

SEQ ID NO: 16204 - RNA, 38 nt, Artificial Sequence
  Description of Artificial Sequence:  Enzymatic Nucleic Acid
  misc_feature (31)..(31): n stands for inosine
gauaauuucugaugaggccguuaggccgaanuucuguc

SEQ ID NO: 16205 - RNA, 38 nt, Artificial Sequence
  Description of Artificial Sequence:  Enzymatic Nucleic Acid
  misc_feature (31)..(31): n stands for inosine
agauaauucugaugaggccguuaggccgaanguucugu

SEQ ID NO: 16206 - RNA, 38 nt, Artificial Sequence
  Description of Artificial Sequence:  Enzymatic Nucleic Acid
  misc_feature (31)..(31): n stands for inosine
aaagauggcugaugaggccguuaggccgaanauaauuu

SEQ ID NO: 16207 - RNA, 38 nt, Artificial Sequence
  Description of Artificial Sequence:  Enzymatic Nucleic Acid
  misc_feature (31)..(31): n stands for inosine
caaaagaucugaugaggccguuaggccgaanagauaau

SEQ ID NO: 16208 - RNA, 38 nt, Artificial Sequence
  Description of Artificial Sequence:  Enzymatic Nucleic Acid
  misc_feature (31)..(31): n stands for inosine
ccaaaagacugaugaggccguuaggccgaangagauaa

SEQ ID NO: 16209 - RNA, 38 nt, Artificial Sequence
  Description of Artificial Sequence:  Enzymatic Nucleic Acid
  misc_feature (31)..(31): n stands for inosine
ccaccaaacugaugaggccguuaggccgaanauggaga

SEQ ID NO: 16210 - RNA, 38 nt, Artificial Sequence
  Description of Artificial Sequence:  Enzymatic Nucleic Acid
  misc_feature (31)..(31): n stands for inosine
uuuugcugcugaugaggccguuaggccgaancaccauu

SEQ ID NO: 16211 - RNA, 38 nt, Artificial Sequence
  Description of Artificial Sequence:  Enzymatic Nucleic Acid
  misc_feature (31)..(31): n stands for inosine
cuuuugcucugaugaggccguuaggccgaangcaccau

SEQ ID NO: 16212 - RNA, 38 nt, Artificial Sequence
  Description of Artificial Sequence:  Enzymatic Nucleic Acid
  misc_feature (31)..(31): n stands for inosine
gcuuuugccugaugaggccguuaggccgaanggcacca

SEQ ID NO: 16213 - RNA, 38 nt, Artificial Sequence
  Description of Artificial Sequence:  Enzymatic Nucleic Acid
  misc_feature (31)..(31): n stands for inosine
ccugcuuucugaugaggccguuaggccgaancugggca

SEQ ID NO: 16214 - RNA, 38 nt, Artificial Sequence
  Description of Artificial Sequence:  Enzymatic Nucleic Acid
  misc_feature (31)..(31): n stands for inosine
agacuccccugaugaggccguuaggccgaancuuuugc

SEQ ID NO: 16215 - RNA, 38 nt, Artificial Sequence
  Description of Artificial Sequence:  Enzymatic Nucleic Acid
  misc_feature (31)..(31): n stands for inosine
gaugccaccugaugaggccguuaggccgaanacucccu

SEQ ID NO: 16216 - RNA, 38 nt, Artificial Sequence
  Description of Artificial Sequence:  Enzymatic Nucleic Acid
  misc_feature (31)..(31): n stands for inosine
ccuucagacugaugaggccguuaggccgaanccacaga

SEQ ID NO: 16217 - RNA, 38 nt, Artificial Sequence
  Description of Artificial Sequence:  Enzymatic Nucleic Acid
  misc_feature (31)..(31): n stands for inosine
gagccuuccugaugaggccguuaggccgaanaugccac

SEQ ID NO: 16218 - RNA, 38 nt, Artificial Sequence
  Description of Artificial Sequence:  Enzymatic Nucleic Acid
  misc_feature (31)..(31): n stands for inosine
cugguuugcugaugaggccguuaggccgaanccuucag

SEQ ID NO: 16219 - RNA, 38 nt, Artificial Sequence
  Description of Artificial Sequence:  Enzymatic Nucleic Acid
  misc_feature (31)..(31): n stands for inosine
gucugguucugaugaggccguuaggccgaanagccuuc

SEQ ID NO: 16220 - RNA, 38 nt, Artificial Sequence
  Description of Artificial Sequence:  Enzymatic Nucleic Acid
  misc_feature (31)..(31): n stands for inosine
gcuugucucugaugaggccguuaggccgaanuuugagc

SEQ ID NO: 16221 - RNA, 38 nt, Artificial Sequence
  Description of Artificial Sequence:  Enzymatic Nucleic Acid
  misc_feature (31)..(31): n stands for inosine
cgcuuguccugaugaggccguuaggccgaanguuugag

SEQ ID NO: 16222 - RNA, 38 nt, Artificial Sequence
  Description of Artificial Sequence:  Enzymatic Nucleic Acid
  misc_feature (31)..(31): n stands for inosine
uagccgcucugaugaggccguuaggccgaanucugguu

SEQ ID NO: 16223 - RNA, 38 nt, Artificial Sequence
  Description of Artificial Sequence:  Enzymatic Nucleic Acid
  misc_feature (31)..(31): n stands for inosine
ggacuggucugaugaggccguuaggccgaanccgcuug

SEQ ID NO: 16224 - RNA, 38 nt, Artificial Sequence
  Description of Artificial Sequence:  Enzymatic Nucleic Acid
  misc_feature (31)..(31): n stands for inosine
uccggacucugaugaggccguuaggccgaanuagccgc

SEQ ID NO: 16225 - RNA, 38 nt, Artificial Sequence
  Description of Artificial Sequence:  Enzymatic Nucleic Acid
  misc_feature (31)..(31): n stands for inosine
auccggaccugaugaggccguuaggccgaanguagccg

SEQ ID NO: 16226 - RNA, 38 nt, Artificial Sequence
  Description of Artificial Sequence:  Enzymatic Nucleic Acid
  misc_feature (31)..(31): n stands for inosine
ugauaucccugaugaggccguuaggccgaanacuggua

SEQ ID NO: 16227 - RNA, 38 nt, Artificial Sequence
  Description of Artificial Sequence:  Enzymatic Nucleic Acid
  misc_feature (31)..(31): n stands for inosine
caucggagcugaugaggccguuaggccgaanauauccg

SEQ ID NO: 16228 - RNA, 38 nt, Artificial Sequence
  Description of Artificial Sequence:  Enzymatic Nucleic Acid
  misc_feature (31)..(31): n stands for inosine
gucaucggcugaugaggccguuaggccgaanugauauc

SEQ ID NO: 16229 - RNA, 38 nt, Artificial Sequence
  Description of Artificial Sequence:  Enzymatic Nucleic Acid
  misc_feature (31)..(31): n stands for inosine
gugucauccugaugaggccguuaggccgaanagugaua

SEQ ID NO: 16230 - RNA, 38 nt, Artificial Sequence
  Description of Artificial Sequence:  Enzymatic Nucleic Acid
  misc_feature (31)..(31): n stands for inosine
ggugucugcugaugaggccguuaggccgaanucaucgg

SEQ ID NO: 16231 - RNA, 38 nt, Artificial Sequence
  Description of Artificial Sequence:  Enzymatic Nucleic Acid
  misc_feature (31)..(31): n stands for inosine
gugguguccugaugaggccguuaggccgaanugucauc

SEQ ID NO: 16232 - RNA, 38 nt, Artificial Sequence
  Description of Artificial Sequence:  Enzymatic Nucleic Acid
  misc_feature (31)..(31): n stands for inosine
cacgguggcugaugaggccguuaggccgaanucugugu

SEQ ID NO: 16233 - RNA, 38 nt, Artificial Sequence
  Description of Artificial Sequence:  Enzymatic Nucleic Acid
  misc_feature (31)..(31): n stands for inosine
uacacggucugaugaggccguuaggccgaanugucugu

SEQ ID NO: 16234 - RNA, 38 nt, Artificial Sequence
  Description of Artificial Sequence:  Enzymatic Nucleic Acid
  misc_feature (31)..(31): n stands for inosine
guacacggcugaugaggccguuaggccgaangugucug

SEQ ID NO: 16235 - RNA, 38 nt, Artificial Sequence
  Description of Artificial Sequence:  Enzymatic Nucleic Acid
  misc_feature (31)..(31): n stands for inosine
gaguacaccugaugaggccguuaggccgaanugguguc

SEQ ID NO: 16236 - RNA, 38 nt, Artificial Sequence
  Description of Artificial Sequence:  Enzymatic Nucleic Acid
  misc_feature (31)..(31): n stands for inosine
cucacuggcugaugaggccguuaggccgaanuacacgg

SEQ ID NO: 16237 - RNA, 38 nt, Artificial Sequence
  Description of Artificial Sequence:  Enzymatic Nucleic Acid
  misc_feature (31)..(31): n stands for inosine
uccucacucugaugaggccguuaggccgaanaguacac

SEQ ID NO: 16238 - RNA, 38 nt, Artificial Sequence
  Description of Artificial Sequence:  Enzymatic Nucleic Acid
  misc_feature (31)..(31): n stands for inosine
uuccucaccugaugaggccguuaggccgaangaguaca

SEQ ID NO: 16239 - RNA, 38 nt, Artificial Sequence
  Description of Artificial Sequence:  Enzymatic Nucleic Acid
  misc_feature (31)..(31): n stands for inosine
aaaaguuccugaugaggccguuaggccgaancuuccuc

SEQ ID NO: 16240 - RNA, 38 nt, Artificial Sequence
  Description of Artificial Sequence:  Enzymatic Nucleic Acid
  misc_feature (31)..(31): n stands for inosine
gcuuuaaacugaugaggccguuaggccgaanuucugcu

SEQ ID NO: 16241 - RNA, 38 nt, Artificial Sequence
  Description of Artificial Sequence:  Enzymatic Nucleic Acid
  misc_feature (31)..(31): n stands for inosine
ucucuauccugaugaggccguuaggccgaancuuuaaa

SEQ ID NO: 16242 - RNA, 38 nt, Artificial Sequence
  Description of Artificial Sequence:  Enzymatic Nucleic Acid
  misc_feature (31)..(31): n stands for inosine
uaccgguucugaugaggccguuaggccgaancacucca

SEQ ID NO: 16243 - RNA, 38 nt, Artificial Sequence
  Description of Artificial Sequence:  Enzymatic Nucleic Acid
  misc_feature (31)..(31): n stands for inosine
gugcuacccugaugaggccguuaggccgaanuuugcac

SEQ ID NO: 16244 - RNA, 38 nt, Artificial Sequence
  Description of Artificial Sequence:  Enzymatic Nucleic Acid
  misc_feature (31)..(31): n stands for inosine
cugggcugcugaugaggccguuaggccgaancuaccgg

SEQ ID NO: 16245 - RNA, 38 nt, Artificial Sequence
  Description of Artificial Sequence:  Enzymatic Nucleic Acid
  misc_feature (31)..(31): n stands for inosine
aucugggccugaugaggccguuaggccgaanugcuacc

SEQ ID NO: 16246 - RNA, 38 nt, Artificial Sequence
  Description of Artificial Sequence:  Enzymatic Nucleic Acid
  misc_feature (31)..(31): n stands for inosine
agaaucugcugaugaggccguuaggccgaancugugcu

SEQ ID NO: 16247 - RNA, 38 nt, Artificial Sequence
  Description of Artificial Sequence:  Enzymatic Nucleic Acid
  misc_feature (31)..(31): n stands for inosine
gagaaucucugaugaggccguuaggccgaangcugugc

SEQ ID NO: 16248 - RNA, 38 nt, Artificial Sequence
  Description of Artificial Sequence:  Enzymatic Nucleic Acid
  misc_feature (31)..(31): n stands for inosine
ggagaauccugaugaggccguuaggccgaanggcugug

SEQ ID NO: 16249 - RNA, 38 nt, Artificial Sequence
  Description of Artificial Sequence:  Enzymatic Nucleic Acid
  misc_feature (31)..(31): n stands for inosine
caggcuggcugaugaggccguuaggccgaanaaucugg

SEQ ID NO: 16250 - RNA, 38 nt, Artificial Sequence
  Description of Artificial Sequence:  Enzymatic Nucleic Acid
  misc_feature (31)..(31): n stands for inosine
gucaggcucugaugaggccguuaggccgaanagaaucu

SEQ ID NO: 16251 - RNA, 38 nt, Artificial Sequence
  Description of Artificial Sequence:  Enzymatic Nucleic Acid
  misc_feature (31)..(31): n stands for inosine
ugucaggccugaugaggccguuaggccgaangagaauc

SEQ ID NO: 16252 - RNA, 38 nt, Artificial Sequence
  Description of Artificial Sequence:  Enzymatic Nucleic Acid
  misc_feature (31)..(31): n stands for inosine
ccgugucacugaugaggccguuaggccgaancuggaga

SEQ ID NO: 16253 - RNA, 38 nt, Artificial Sequence
  Description of Artificial Sequence:  Enzymatic Nucleic Acid
  misc_feature (31)..(31): n stands for inosine
cccguguccugaugaggccguuaggccgaangcuggag

SEQ ID NO: 16254 - RNA, 38 nt, Artificial Sequence
  Description of Artificial Sequence:  Enzymatic Nucleic Acid
  misc_feature (31)..(31): n stands for inosine
gguccccgcugaugaggccguuaggccgaanucaggcu

SEQ ID NO: 16255 - RNA, 38 nt, Artificial Sequence
  Description of Artificial Sequence:  Enzymatic Nucleic Acid
  misc_feature (31)..(31): n stands for inosine
cucagugucugaugaggccguuaggccgaanuccccgu

SEQ ID NO: 16256 - RNA, 38 nt, Artificial Sequence
  Description of Artificial Sequence:  Enzymatic Nucleic Acid
  misc_feature (31)..(31): n stands for inosine
gcucagugcugaugaggccguuaggccgaanguccccg

SEQ ID NO: 16257 - RNA, 38 nt, Artificial Sequence
  Description of Artificial Sequence:  Enzymatic Nucleic Acid
  misc_feature (31)..(31): n stands for inosine
gagcucagcugaugaggccguuaggccgaanugguccc

SEQ ID NO: 16258 - RNA, 38 nt, Artificial Sequence
  Description of Artificial Sequence:  Enzymatic Nucleic Acid
  misc_feature (31)..(31): n stands for inosine
gagagcuccugaugaggccguuaggccgaanugugguc

SEQ ID NO: 16259 - RNA, 38 nt, Artificial Sequence
  Description of Artificial Sequence:  Enzymatic Nucleic Acid
  misc_feature (31)..(31): n stands for inosine
aggaggagcugaugaggccguuaggccgaancucagug

SEQ ID NO: 16260 - RNA, 38 nt, Artificial Sequence
  Description of Artificial Sequence:  Enzymatic Nucleic Acid
  misc_feature (31)..(31): n stands for inosine
acaggaggcugaugaggccguuaggccgaanagcucag

SEQ ID NO: 16261 - RNA, 38 nt, Artificial Sequence
  Description of Artificial Sequence:  Enzymatic Nucleic Acid
  misc_feature (31)..(31): n stands for inosine
aaacaggacugaugaggccguuaggccgaanagagcuc

SEQ ID NO: 16262 - RNA, 38 nt, Artificial Sequence
  Description of Artificial Sequence:  Enzymatic Nucleic Acid
  misc_feature (31)..(31): n stands for inosine
uaaacaggcugaugaggccguuaggccgaangagagcu

SEQ ID NO: 16263 - RNA, 38 nt, Artificial Sequence
  Description of Artificial Sequence:  Enzymatic Nucleic Acid
  misc_feature (31)..(31): n stands for inosine
uuuaaacacugaugaggccguuaggccgaanaggagag

SEQ ID NO: 16264 - RNA, 38 nt, Artificial Sequence
  Description of Artificial Sequence:  Enzymatic Nucleic Acid
  misc_feature (31)..(31): n stands for inosine
uuuuaaaccugaugaggccguuaggccgaangaggaga

SEQ ID NO: 16265 - RNA, 38 nt, Artificial Sequence
  Description of Artificial Sequence:  Enzymatic Nucleic Acid
  misc_feature (31)..(31): n stands for inosine
gguguggacugaugaggccguuaggccgaancuuccuu

SEQ ID NO: 16266 - RNA, 38 nt, Artificial Sequence
  Description of Artificial Sequence:  Enzymatic Nucleic Acid
  misc_feature (31)..(31): n stands for inosine
uggggugucugaugaggccguuaggccgaanaugcuuc

SEQ ID NO: 16267 - RNA, 38 nt, Artificial Sequence
  Description of Artificial Sequence:  Enzymatic Nucleic Acid
  misc_feature (31)..(31): n stands for inosine
uuggggugcugaugaggccguuaggccgaangaugcuu

SEQ ID NO: 16268 - RNA, 38 nt, Artificial Sequence
  Description of Artificial Sequence:  Enzymatic Nucleic Acid
  misc_feature (31)..(31): n stands for inosine
aguuggggcugaugaggccguuaggccgaanuggaugc

SEQ ID NO: 16269 - RNA, 38 nt, Artificial Sequence
  Description of Artificial Sequence:  Enzymatic Nucleic Acid
  misc_feature (31)..(31): n stands for inosine
ggaguuggcugaugaggccguuaggccgaanuguggau

SEQ ID NO: 16270 - RNA, 38 nt, Artificial Sequence
  Description of Artificial Sequence:  Enzymatic Nucleic Acid
  misc_feature (31)..(31): n stands for inosine
gggaguugcugaugaggccguuaggccgaangugugga

SEQ ID NO: 16271 - RNA, 38 nt, Artificial Sequence
  Description of Artificial Sequence:  Enzymatic Nucleic Acid
  misc_feature (31)..(31): n stands for inosine
cgggaguucugaugaggccguuaggccgaanggugugg

SEQ ID NO: 16272 - RNA, 38 nt, Artificial Sequence
  Description of Artificial Sequence:  Enzymatic Nucleic Acid
  misc_feature (31)..(31): n stands for inosine
ccgggagucugaugaggccguuaggccgaangggugug

SEQ ID NO: 16273 - RNA, 38 nt, Artificial Sequence
  Description of Artificial Sequence:  Enzymatic Nucleic Acid
  misc_feature (31)..(31): n stands for inosine
uguccgggcugaugaggccguuaggccgaanuuggggu

SEQ ID NO: 16274 - RNA, 38 nt, Artificial Sequence
  Description of Artificial Sequence:  Enzymatic Nucleic Acid
  misc_feature (31)..(31): n stands for inosine
gauguccgcugaugaggccguuaggccgaanaguuggg

SEQ ID NO: 16275 - RNA, 38 nt, Artificial Sequence
  Description of Artificial Sequence:  Enzymatic Nucleic Acid
  misc_feature (31)..(31): n stands for inosine
ugaugucccugaugaggccguuaggccgaangaguugg

SEQ ID NO: 16276 - RNA, 38 nt, Artificial Sequence
  Description of Artificial Sequence:  Enzymatic Nucleic Acid
  misc_feature (31)..(31): n stands for inosine
ucaugugacugaugaggccguuaggccgaanuccggga

SEQ ID NO: 16277 - RNA, 38 nt, Artificial Sequence
  Description of Artificial Sequence:  Enzymatic Nucleic Acid
  misc_feature (31)..(31): n stands for inosine
cucucaugcugaugaggccguuaggccgaanauguccg

SEQ ID NO: 16278 - RNA, 38 nt, Artificial Sequence
  Description of Artificial Sequence:  Enzymatic Nucleic Acid
  misc_feature (31)..(31): n stands for inosine
accucucacugaugaggccguuaggccgaanugauguc

SEQ ID NO: 16279 - RNA, 38 nt, Artificial Sequence
  Description of Artificial Sequence:  Enzymatic Nucleic Acid
  misc_feature (31)..(31): n stands for inosine
aucugagccugaugaggccguuaggccgaanaccucuc

SEQ ID NO: 16280 - RNA, 38 nt, Artificial Sequence
  Description of Artificial Sequence:  Enzymatic Nucleic Acid
  misc_feature (31)..(31): n stands for inosine
aaaaucugcugaugaggccguuaggccgaancagaccu

SEQ ID NO: 16281 - RNA, 38 nt, Artificial Sequence
  Description of Artificial Sequence:  Enzymatic Nucleic Acid
  misc_feature (31)..(31): n stands for inosine
ucaaaauccugaugaggccguuaggccgaanagcagac

SEQ ID NO: 16282 - RNA, 38 nt, Artificial Sequence
  Description of Artificial Sequence:  Enzymatic Nucleic Acid
  misc_feature (31)..(31): n stands for inosine
ugguggaacugaugaggccguuaggccgaanaacaaca

SEQ ID NO: 16283 - RNA, 38 nt, Artificial Sequence
  Description of Artificial Sequence:  Enzymatic Nucleic Acid
  misc_feature (31)..(31): n stands for inosine
cugcuggucugaugaggccguuaggccgaanaaagaac

SEQ ID NO: 16284 - RNA, 38 nt, Artificial Sequence
  Description of Artificial Sequence:  Enzymatic Nucleic Acid
  misc_feature (31)..(31): n stands for inosine
ccugcuggcugaugaggccguuaggccgaangaaagaa

SEQ ID NO: 16285 - RNA, 38 nt, Artificial Sequence
  Description of Artificial Sequence:  Enzymatic Nucleic Acid
  misc_feature (31)..(31): n stands for inosine
uuccugcucugaugaggccguuaggccgaanuggaaag

SEQ ID NO: 16286 - RNA, 38 nt, Artificial Sequence
  Description of Artificial Sequence:  Enzymatic Nucleic Acid
  misc_feature (31)..(31): n stands for inosine
cuuccugccugaugaggccguuaggccgaanguggaaa

SEQ ID NO: 16287 - RNA, 38 nt, Artificial Sequence
  Description of Artificial Sequence:  Enzymatic Nucleic Acid
  misc_feature (31)..(31): n stands for inosine
cuacuucccugaugaggccguuaggccgaancuggugg

SEQ ID NO: 16288 - RNA, 38 nt, Artificial Sequence
  Description of Artificial Sequence:  Enzymatic Nucleic Acid
  misc_feature (31)..(31): n stands for inosine
ucaaaugccugaugaggccguuaggccgaancuacuuc

SEQ ID NO: 16289 - RNA, 38 nt, Artificial Sequence
  Description of Artificial Sequence:  Enzymatic Nucleic Acid
  misc_feature (31)..(31): n stands for inosine
aaaucaaacugaugaggccguuaggccgaancggcuac

SEQ ID NO: 16290 - RNA, 38 nt, Artificial Sequence
  Description of Artificial Sequence:  Enzymatic Nucleic Acid
  misc_feature (31)..(31): n stands for inosine
ugucgaaacugaugaggccguuaggccgaanaaaauca

SEQ ID NO: 16291 - RNA, 38 nt, Artificial Sequence
  Description of Artificial Sequence:  Enzymatic Nucleic Acid
  misc_feature (31)..(31): n stands for inosine
uuuucugucugaugaggccguuaggccgaanucgaaau

SEQ ID NO: 16292 - RNA, 38 nt, Artificial Sequence
  Description of Artificial Sequence:  Enzymatic Nucleic Acid
  misc_feature (31)..(31): n stands for inosine
ccuuuuuccugaugaggccguuaggccgaanuugucga

SEQ ID NO: 16293 - RNA, 38 nt, Artificial Sequence
  Description of Artificial Sequence:  Enzymatic Nucleic Acid
  misc_feature (31)..(31): n stands for inosine
caguccgacugaugaggccguuaggccgaanuccuuuu

SEQ ID NO: 16294 - RNA, 38 nt, Artificial Sequence
  Description of Artificial Sequence:  Enzymatic Nucleic Acid
  misc_feature (31)..(31): n stands for inosine
gcaguccgcugaugaggccguuaggccgaanguccuuu

SEQ ID NO: 16295 - RNA, 38 nt, Artificial Sequence
  Description of Artificial Sequence:  Enzymatic Nucleic Acid
  misc_feature (31)..(31): n stands for inosine
cucccugccugaugaggccguuaggccgaanuccgagg

SEQ ID NO: 16296 - RNA, 38 nt, Artificial Sequence
  Description of Artificial Sequence:  Enzymatic Nucleic Acid
  misc_feature (31)..(31): n stands for inosine
uggcuccccugaugaggccguuaggccgaancaguccg

SEQ ID NO: 16297 - RNA, 38 nt, Artificial Sequence
  Description of Artificial Sequence:  Enzymatic Nucleic Acid
  misc_feature (31)..(31): n stands for inosine
gaagagcucugaugaggccguuaggccgaancucccug

SEQ ID NO: 16298 - RNA, 38 nt, Artificial Sequence
  Description of Artificial Sequence:  Enzymatic Nucleic Acid
  misc_feature (31)..(31): n stands for inosine
agaagagccugaugaggccguuaggccgaangcucccu

SEQ ID NO: 16299 - RNA, 38 nt, Artificial Sequence
  Description of Artificial Sequence:  Enzymatic Nucleic Acid
  misc_feature (31)..(31): n stands for inosine
ccuagaagcugaugaggccguuaggccgaancuggcuc

SEQ ID NO: 16300 - RNA, 38 nt, Artificial Sequence
  Description of Artificial Sequence:  Enzymatic Nucleic Acid
  misc_feature (31)..(31): n stands for inosine
agccuagacugaugaggccguuaggccgaanagcuggc

SEQ ID NO: 16301 - RNA, 38 nt, Artificial Sequence
  Description of Artificial Sequence:  Enzymatic Nucleic Acid
  misc_feature (31)..(31): n stands for inosine
acaagccucugaugaggccguuaggccgaanaagagcu

SEQ ID NO: 16302 - RNA, 36 nt, Artificial Sequence
  Description of Artificial Sequence:  Enzymatic Nucleic Acid
gccagugauggcaugcacuaugcgcgagcaccuugc

SEQ ID NO: 16303 - RNA, 36 nt, Artificial Sequence
  Description of Artificial Sequence:  Enzymatic Nucleic Acid
cagggugauggcaugcacuaugcgcggacggccagc

SEQ ID NO: 16304 - RNA, 36 nt, Artificial Sequence
  Description of Artificial Sequence:  Enzymatic Nucleic Acid
ccacgugauggcaugcacuaugcgcgagagccacag

SEQ ID NO: 16305 - RNA, 36 nt, Artificial Sequence
  Description of Artificial Sequence:  Enzymatic Nucleic Acid
agaggugauggcaugcacuaugcgcgggcccggguc

SEQ ID NO: 16306 - RNA, 36 nt, Artificial Sequence
  Description of Artificial Sequence:  Enzymatic Nucleic Acid
cuaggugauggcaugcacuaugcgcgaaacccacag

SEQ ID NO: 16307 - RNA, 36 nt, Artificial Sequence
  Description of Artificial Sequence:  Enzymatic Nucleic Acid
cagauugauggcaugcacuaugcgcgaagagaaaca

SEQ ID NO: 16308 - RNA, 36 nt, Artificial Sequence
  Description of Artificial Sequence:  Enzymatic Nucleic Acid
cugggugauggcaugcacuaugcgcgagaucaagag

SEQ ID NO: 16309 - RNA, 36 nt, Artificial Sequence
  Description of Artificial Sequence:  Enzymatic Nucleic Acid
cccugugauggcaugcacuaugcgcgaaguaauuug

SEQ ID NO: 16310 - RNA, 36 nt, Artificial Sequence
  Description of Artificial Sequence:  Enzymatic Nucleic Acid
uugcuugauggcaugcacuaugcgcgacugccacuc

SEQ ID NO: 16311 - RNA, 36 nt, Artificial Sequence
  Description of Artificial Sequence:  Enzymatic Nucleic Acid
ucaguugauggcaugcacuaugcgcgaccuccaccc

SEQ ID NO: 16312 - RNA, 36 nt, Artificial Sequence
  Description of Artificial Sequence:  Enzymatic Nucleic Acid
gcacuugauggcaugcacuaugcgcgagucaccucc

SEQ ID NO: 16313 - RNA, 36 nt, Artificial Sequence
  Description of Artificial Sequence:  Enzymatic Nucleic Acid
cgcugugauggcaugcacuaugcgcgacucagucac

SEQ ID NO: 16314 - RNA, 36 nt, Artificial Sequence
  Description of Artificial Sequence:  Enzymatic Nucleic Acid
gccauugauggcaugcacuaugcgcggcugcacuca

SEQ ID NO: 16315 - RNA, 36 nt, Artificial Sequence
  Description of Artificial Sequence:  Enzymatic Nucleic Acid
ccgauugauggcaugcacuaugcgcgacuuuuggaa

SEQ ID NO: 16316 - RNA, 36 nt, Artificial Sequence
  Description of Artificial Sequence:  Enzymatic Nucleic Acid
aguguugauggcaugcacuaugcgcgauuuccgauc

SEQ ID NO: 16317 - RNA, 36 nt, Artificial Sequence
  Description of Artificial Sequence:  Enzymatic Nucleic Acid
agaagugauggcaugcacuaugcgcgacuuguaggc

SEQ ID NO: 16318 - RNA, 36 nt, Artificial Sequence
  Description of Artificial Sequence:  Enzymatic Nucleic Acid
caaguugauggcaugcacuaugcgcgaguuucccgg

SEQ ID NO: 16319 - RNA, 36 nt, Artificial Sequence
  Description of Artificial Sequence:  Enzymatic Nucleic Acid
agaagugauggcaugcacuaugcgcgaauaaaugga

SEQ ID NO: 16320 - RNA, 36 nt, Artificial Sequence
  Description of Artificial Sequence:  Enzymatic Nucleic Acid
uugguugauggcaugcacuaugcgcgacuaacagaa

SEQ ID NO: 16321 - RNA, 36 nt, Artificial Sequence
  Description of Artificial Sequence:  Enzymatic Nucleic Acid
guucuugauggcaugcacuaugcgcgaguaauguac

SEQ ID NO: 16322 - RNA, 36 nt, Artificial Sequence
  Description of Artificial Sequence:  Enzymatic Nucleic Acid
ggaauugauggcaugcacuaugcgcgaccacaguuu

SEQ ID NO: 16323 - RNA, 36 nt, Artificial Sequence
  Description of Artificial Sequence:  Enzymatic Nucleic Acid
ucuugugauggcaugcacuaugcgcgacaaagugac

SEQ ID NO: 16324 - RNA, 36 nt, Artificial Sequence
  Description of Artificial Sequence:  Enzymatic Nucleic Acid
accauugauggcaugcacuaugcgcgaggaacaaau

SEQ ID NO: 16325 - RNA, 36 nt, Artificial Sequence
  Description of Artificial Sequence:  Enzymatic Nucleic Acid
cugauugauggcaugcacuaugcgcgauguagcugg

SEQ ID NO: 16326 - RNA, 36 nt, Artificial Sequence
  Description of Artificial Sequence:  Enzymatic Nucleic Acid
gccagugauggcaugcacuaugcgcgauagcugauc

SEQ ID NO: 16327 - RNA, 36 nt, Artificial Sequence
  Description of Artificial Sequence:  Enzymatic Nucleic Acid
ugcuuugauggcaugcacuaugcgcgacagaagacc

SEQ ID NO: 16328 - RNA, 36 nt, Artificial Sequence
  Description of Artificial Sequence:  Enzymatic Nucleic Acid
uucauugauggcaugcacuaugcgcgauuaauuuuu

SEQ ID NO: 16329 - RNA, 36 nt, Artificial Sequence
  Description of Artificial Sequence:  Enzymatic Nucleic Acid
acuuuugauggcaugcacuaugcgcgaucauuaauu

SEQ ID NO: 16330 - RNA, 36 nt, Artificial Sequence
  Description of Artificial Sequence:  Enzymatic Nucleic Acid
cacauugauggcaugcacuaugcgcgauaaauccua

SEQ ID NO: 16331 - RNA, 36 nt, Artificial Sequence
  Description of Artificial Sequence:  Enzymatic Nucleic Acid
ggacuugauggcaugcacuaugcgcgagaaccacau

SEQ ID NO: 16332 - RNA, 36 nt, Artificial Sequence
  Description of Artificial Sequence:  Enzymatic Nucleic Acid
uaguuugauggcaugcacuaugcgcgaauuccauga

SEQ ID NO: 16333 - RNA, 36 nt, Artificial Sequence
  Description of Artificial Sequence:  Enzymatic Nucleic Acid
uaguuugauggcaugcacuaugcgcgaguucuugcu

SEQ ID NO: 16334 - RNA, 36 nt, Artificial Sequence
  Description of Artificial Sequence:  Enzymatic Nucleic Acid
gaaguugauggcaugcacuaugcgcgaauccccaca

SEQ ID NO: 16335 - RNA, 36 nt, Artificial Sequence
  Description of Artificial Sequence:  Enzymatic Nucleic Acid
ugcuuugauggcaugcacuaugcgcggaagaagggu

SEQ ID NO: 16336 - RNA, 36 nt, Artificial Sequence
  Description of Artificial Sequence:  Enzymatic Nucleic Acid
ggucuugauggcaugcacuaugcgcggguuuacaag

SEQ ID NO: 16337 - RNA, 36 nt, Artificial Sequence
  Description of Artificial Sequence:  Enzymatic Nucleic Acid
caucuugauggcaugcacuaugcgcgacucccagac

SEQ ID NO: 16338 - RNA, 36 nt, Artificial Sequence
  Description of Artificial Sequence:  Enzymatic Nucleic Acid
uucuuugauggcaugcacuaugcgcgaucucacucc

SEQ ID NO: 16339 - RNA, 36 nt, Artificial Sequence
  Description of Artificial Sequence:  Enzymatic Nucleic Acid
gugcuugauggcaugcacuaugcgcgaaaaauuucu

SEQ ID NO: 16340 - RNA, 36 nt, Artificial Sequence
  Description of Artificial Sequence:  Enzymatic Nucleic Acid
uugguugauggcaugcacuaugcgcgacuccggguu

SEQ ID NO: 16341 - RNA, 36 nt, Artificial Sequence
  Description of Artificial Sequence:  Enzymatic Nucleic Acid
ugcugugauggcaugcacuaugcgcgacagguguac

SEQ ID NO: 16342 - RNA, 36 nt, Artificial Sequence
  Description of Artificial Sequence:  Enzymatic Nucleic Acid
gucauugauggcaugcacuaugcgcgagcccacugg

SEQ ID NO: 16343 - RNA, 36 nt, Artificial Sequence
  Description of Artificial Sequence:  Enzymatic Nucleic Acid
uugguugauggcaugcacuaugcgcgaucagcccac

SEQ ID NO: 16344 - RNA, 36 nt, Artificial Sequence
  Description of Artificial Sequence:  Enzymatic Nucleic Acid
uuuuuugauggcaugcacuaugcgcgauggacccug

SEQ ID NO: 16345 - RNA, 36 nt, Artificial Sequence
  Description of Artificial Sequence:  Enzymatic Nucleic Acid
aaaagugauggcaugcacuaugcgcgaacaaaaggu

SEQ ID NO: 16346 - RNA, 36 nt, Artificial Sequence
  Description of Artificial Sequence:  Enzymatic Nucleic Acid
cuucgugauggcaugcacuaugcgcgagggauucug

SEQ ID NO: 16347 - RNA, 36 nt, Artificial Sequence
  Description of Artificial Sequence:  Enzymatic Nucleic Acid
uacuuugauggcaugcacuaugcgcggcagggauuc

SEQ ID NO: 16348 - RNA, 36 nt, Artificial Sequence
  Description of Artificial Sequence:  Enzymatic Nucleic Acid
ggacuugauggcaugcacuaugcgcgaagggguauu

SEQ ID NO: 16349 - RNA, 36 nt, Artificial Sequence
  Description of Artificial Sequence:  Enzymatic Nucleic Acid
aucguugauggcaugcacuaugcgcgaguacaugcc

SEQ ID NO: 16350 - RNA, 36 nt, Artificial Sequence
  Description of Artificial Sequence:  Enzymatic Nucleic Acid
auaauugauggcaugcacuaugcgcggucaguacau

SEQ ID NO: 16351 - RNA, 36 nt, Artificial Sequence
  Description of Artificial Sequence:  Enzymatic Nucleic Acid
ucacuugauggcaugcacuaugcgcgacuuccauaa

SEQ ID NO: 16352 - RNA, 36 nt, Artificial Sequence
  Description of Artificial Sequence:  Enzymatic Nucleic Acid
ucuuuugauggcaugcacuaugcgcgacucacuucc

SEQ ID NO: 16353 - RNA, 36 nt, Artificial Sequence
  Description of Artificial Sequence:  Enzymatic Nucleic Acid
uuucuugauggcaugcacuaugcgcgaccaaucugg

SEQ ID NO: 16354 - RNA, 36 nt, Artificial Sequence
  Description of Artificial Sequence:  Enzymatic Nucleic Acid
gucagugauggcaugcacuaugcgcgguuugagugg

SEQ ID NO: 16355 - RNA, 36 nt, Artificial Sequence
  Description of Artificial Sequence:  Enzymatic Nucleic Acid
cauguugauggcaugcacuaugcgcgagcguuugag

SEQ ID NO: 16356 - RNA, 36 nt, Artificial Sequence
  Description of Artificial Sequence:  Enzymatic Nucleic Acid
aauggugauggcaugcacuaugcgcgauagaccgua

SEQ ID NO: 16357 - RNA, 36 nt, Artificial Sequence
  Description of Artificial Sequence:  Enzymatic Nucleic Acid
ugaugugauggcaugcacuaugcgcggggggaggaa

SEQ ID NO: 16358 - RNA, 36 nt, Artificial Sequence
  Description of Artificial Sequence:  Enzymatic Nucleic Acid
uggcgugauggcaugcacuaugcgcgacucuuccuc

SEQ ID NO: 16359 - RNA, 36 nt, Artificial Sequence
  Description of Artificial Sequence:  Enzymatic Nucleic Acid
guuggugauggcaugcacuaugcgcggcacucuucc

SEQ ID NO: 16360 - RNA, 36 nt, Artificial Sequence
  Description of Artificial Sequence:  Enzymatic Nucleic Acid
gggcuugauggcaugcacuaugcgcgguuggcgcac

SEQ ID NO: 16361 - RNA, 36 nt, Artificial Sequence
  Description of Artificial Sequence:  Enzymatic Nucleic Acid
uuuguugauggcaugcacuaugcgcgacugagacag

SEQ ID NO: 16362 - RNA, 36 nt, Artificial Sequence
  Description of Artificial Sequence:  Enzymatic Nucleic Acid
uucuuugauggcaugcacuaugcgcgacaaggguau

SEQ ID NO: 16363 - RNA, 36 nt, Artificial Sequence
  Description of Artificial Sequence:  Enzymatic Nucleic Acid
aacuuugauggcaugcacuaugcgcgaauuuuauuu

SEQ ID NO: 16364 - RNA, 36 nt, Artificial Sequence
  Description of Artificial Sequence:  Enzymatic Nucleic Acid
uagagugauggcaugcacuaugcgcgaaauugauuu

SEQ ID NO: 16365 - RNA, 36 nt, Artificial Sequence
  Description of Artificial Sequence:  Enzymatic Nucleic Acid
uccuuugauggcaugcacuaugcgcgaauuagagca

SEQ ID NO: 16366 - RNA, 36 nt, Artificial Sequence
  Description of Artificial Sequence:  Enzymatic Nucleic Acid
cgcuuugauggcaugcacuaugcgcgacauuuguac

SEQ ID NO: 16367 - RNA, 36 nt, Artificial Sequence
  Description of Artificial Sequence:  Enzymatic Nucleic Acid
gagauugauggcaugcacuaugcgcgacccucucuc

SEQ ID NO: 16368 - RNA, 36 nt, Artificial Sequence
  Description of Artificial Sequence:  Enzymatic Nucleic Acid
cugguugauggcaugcacuaugcgcgacguggaagg

SEQ ID NO: 16369 - RNA, 36 nt, Artificial Sequence
  Description of Artificial Sequence:  Enzymatic Nucleic Acid
aauuuugauggcaugcacuaugcgcgaggaccccug

SEQ ID NO: 16370 - RNA, 36 nt, Artificial Sequence
  Description of Artificial Sequence:  Enzymatic Nucleic Acid
gguugugauggcaugcacuaugcgcgaaaguaauuu

SEQ ID NO: 16371 - RNA, 36 nt, Artificial Sequence
  Description of Artificial Sequence:  Enzymatic Nucleic Acid
cauguugauggcaugcacuaugcgcgagguugcaaa

SEQ ID NO: 16372 - RNA, 36 nt, Artificial Sequence
  Description of Artificial Sequence:  Enzymatic Nucleic Acid
ggcugugauggcaugcacuaugcgcgaugucagguu

SEQ ID NO: 16373 - RNA, 36 nt, Artificial Sequence
  Description of Artificial Sequence:  Enzymatic Nucleic Acid
cugcuugauggcaugcacuaugcgcgagugggcugc

SEQ ID NO: 16374 - RNA, 36 nt, Artificial Sequence
  Description of Artificial Sequence:  Enzymatic Nucleic Acid
cagugugauggcaugcacuaugcgcgaccacaaaga

SEQ ID NO: 16375 - RNA, 36 nt, Artificial Sequence
  Description of Artificial Sequence:  Enzymatic Nucleic Acid
gucugugauggcaugcacuaugcgcgagugcaccac

SEQ ID NO: 16376 - RNA, 36 nt, Artificial Sequence
  Description of Artificial Sequence:  Enzymatic Nucleic Acid
guucuugauggcaugcacuaugcgcgaaacguagau

SEQ ID NO: 16377 - RNA, 36 nt, Artificial Sequence
  Description of Artificial Sequence:  Enzymatic Nucleic Acid
auuggugauggcaugcacuaugcgcgagaggcugug

SEQ ID NO: 16378 - RNA, 36 nt, Artificial Sequence
  Description of Artificial Sequence:  Enzymatic Nucleic Acid
gugggugauggcaugcacuaugcgcgaacucuccca

SEQ ID NO: 16379 - RNA, 36 nt, Artificial Sequence
  Description of Artificial Sequence:  Enzymatic Nucleic Acid
ucuugugauggcaugcacuaugcgcgaaacaggugu

SEQ ID NO: 16380 - RNA, 36 nt, Artificial Sequence
  Description of Artificial Sequence:  Enzymatic Nucleic Acid
gcauuugauggcaugcacuaugcgcgaauuuccaaa

SEQ ID NO: 16381 - RNA, 36 nt, Artificial Sequence
  Description of Artificial Sequence:  Enzymatic Nucleic Acid
gguggugauggcaugcacuaugcgcgauucaauuuc

SEQ ID NO: 16382 - RNA, 36 nt, Artificial Sequence
  Description of Artificial Sequence:  Enzymatic Nucleic Acid
aauguugauggcaugcacuaugcgcgauuugugcua

SEQ ID NO: 16383 - RNA, 36 nt, Artificial Sequence
  Description of Artificial Sequence:  Enzymatic Nucleic Acid
augauugauggcaugcacuaugcgcgaaaaugucau

SEQ ID NO: 16384 - RNA, 36 nt, Artificial Sequence
  Description of Artificial Sequence:  Enzymatic Nucleic Acid
ggaugugauggcaugcacuaugcgcgauucuuaagc

SEQ ID NO: 16385 - RNA, 36 nt, Artificial Sequence
  Description of Artificial Sequence:  Enzymatic Nucleic Acid
uccugugauggcaugcacuaugcgcgaaggaugcau

SEQ ID NO: 16386 - RNA, 36 nt, Artificial Sequence
  Description of Artificial Sequence:  Enzymatic Nucleic Acid
caaggugauggcaugcacuaugcgcgagacauaguc

SEQ ID NO: 16387 - RNA, 36 nt, Artificial Sequence
  Description of Artificial Sequence:  Enzymatic Nucleic Acid
uugagugauggcaugcacuaugcgcgaaggcagaca

SEQ ID NO: 16388 - RNA, 36 nt, Artificial Sequence
  Description of Artificial Sequence:  Enzymatic Nucleic Acid
ccacgugauggcaugcacuaugcgcgaaugucuuuu

SEQ ID NO: 16389 - RNA, 36 nt, Artificial Sequence
  Description of Artificial Sequence:  Enzymatic Nucleic Acid
gugauugauggcaugcacuaugcgcggugggugcca

SEQ ID NO: 16390 - RNA, 36 nt, Artificial Sequence
  Description of Artificial Sequence:  Enzymatic Nucleic Acid
cuuguugauggcaugcacuaugcgcggucugauucu

SEQ ID NO: 16391 - RNA, 36 nt, Artificial Sequence
  Description of Artificial Sequence:  Enzymatic Nucleic Acid
gacuuugauggcaugcacuaugcgcggaugcuuucc

SEQ ID NO: 16392 - RNA, 36 nt, Artificial Sequence
  Description of Artificial Sequence:  Enzymatic Nucleic Acid
ccgugugauggcaugcacuaugcgcgaugagacuuc

SEQ ID NO: 16393 - RNA, 36 nt, Artificial Sequence
  Description of Artificial Sequence:  Enzymatic Nucleic Acid
ggucuugauggcaugcacuaugcgcgauuaucuuua

SEQ ID NO: 16394 - RNA, 36 nt, Artificial Sequence
  Description of Artificial Sequence:  Enzymatic Nucleic Acid
uccuuugauggcaugcacuaugcgcgaauacaaugc

SEQ ID NO: 16395 - RNA, 36 nt, Artificial Sequence
  Description of Artificial Sequence:  Enzymatic Nucleic Acid
cucugugauggcaugcacuaugcgcgggauagugag

SEQ ID NO: 16396 - RNA, 36 nt, Artificial Sequence
  Description of Artificial Sequence:  Enzymatic Nucleic Acid
uuccuugauggcaugcacuaugcgcgacucugcgga

SEQ ID NO: 16397 - RNA, 36 nt, Artificial Sequence
  Description of Artificial Sequence:  Enzymatic Nucleic Acid
gccuuugauggcaugcacuaugcgcgguccuccuuc

SEQ ID NO: 16398 - RNA, 36 nt, Artificial Sequence
  Description of Artificial Sequence:  Enzymatic Nucleic Acid
ccuggugauggcaugcacuaugcgcgagguguagag

SEQ ID NO: 16399 - RNA, 36 nt, Artificial Sequence
  Description of Artificial Sequence:  Enzymatic Nucleic Acid
cacugugauggcaugcacuaugcgcgaugccuggca

SEQ ID NO: 16400 - RNA, 36 nt, Artificial Sequence
  Description of Artificial Sequence:  Enzymatic Nucleic Acid
uuuugugauggcaugcacuaugcgcgacagccaaga

SEQ ID NO: 16401 - RNA, 36 nt, Artificial Sequence
  Description of Artificial Sequence:  Enzymatic Nucleic Acid
cugggugauggcaugcacuaugcgcgaccuucuauu

SEQ ID NO: 16402 - RNA, 36 nt, Artificial Sequence
  Description of Artificial Sequence:  Enzymatic Nucleic Acid
aaguuugauggcaugcacuaugcgcggucuuuuccu

SEQ ID NO: 16403 - RNA, 36 nt, Artificial Sequence
  Description of Artificial Sequence:  Enzymatic Nucleic Acid
accguugauggcaugcacuaugcgcggugccuacua

SEQ ID NO: 16404 - RNA, 36 nt, Artificial Sequence
  Description of Artificial Sequence:  Enzymatic Nucleic Acid
gcaauugauggcaugcacuaugcgcgaccgucgugc

SEQ ID NO: 16405 - RNA, 36 nt, Artificial Sequence
  Description of Artificial Sequence:  Enzymatic Nucleic Acid
cauggugauggcaugcacuaugcgcgaaucaccguc

SEQ ID NO: 16406 - RNA, 36 nt, Artificial Sequence
  Description of Artificial Sequence:  Enzymatic Nucleic Acid
gucuuugauggcaugcacuaugcgcgaguuccccuc

SEQ ID NO: 16407 - RNA, 36 nt, Artificial Sequence
  Description of Artificial Sequence:  Enzymatic Nucleic Acid
gaguuugauggcaugcacuaugcgcgaucuggaucc

SEQ ID NO: 16408 - RNA, 36 nt, Artificial Sequence
  Description of Artificial Sequence:  Enzymatic Nucleic Acid
auguuugauggcaugcacuaugcgcgauccaauggg

SEQ ID NO: 16409 - RNA, 36 nt, Artificial Sequence
  Description of Artificial Sequence:  Enzymatic Nucleic Acid
ucguuugauggcaugcacuaugcgcgacaauguuca

SEQ ID NO: 16410 - RNA, 36 nt, Artificial Sequence
  Description of Artificial Sequence:  Enzymatic Nucleic Acid
gcaguugauggcaugcacuaugcgcgguucacaaug

SEQ ID NO: 16411 - RNA, 36 nt, Artificial Sequence
  Description of Artificial Sequence:  Enzymatic Nucleic Acid
uaaggugauggcaugcacuaugcgcgagucguucac

SEQ ID NO: 16412 - RNA, 36 nt, Artificial Sequence
  Description of Artificial Sequence:  Enzymatic Nucleic Acid
ggcauugauggcaugcacuaugcgcgauaaggcagu

SEQ ID NO: 16413 - RNA, 36 nt, Artificial Sequence
  Description of Artificial Sequence:  Enzymatic Nucleic Acid
gcuggugauggcaugcacuaugcgcgaucauaaggc

SEQ ID NO: 16414 - RNA, 36 nt, Artificial Sequence
  Description of Artificial Sequence:  Enzymatic Nucleic Acid
agguuugauggcaugcacuaugcgcgagccggucuc

SEQ ID NO: 16415 - RNA, 36 nt, Artificial Sequence
  Description of Artificial Sequence:  Enzymatic Nucleic Acid
aaaggugauggcaugcacuaugcgcgaccacggcca

SEQ ID NO: 16416 - RNA, 36 nt, Artificial Sequence
  Description of Artificial Sequence:  Enzymatic Nucleic Acid
ugcuuugauggcaugcacuaugcgcgaaucucuugg

SEQ ID NO: 16417 - RNA, 36 nt, Artificial Sequence
  Description of Artificial Sequence:  Enzymatic Nucleic Acid
aaaggugauggcaugcacuaugcgcgaucugcuuca

SEQ ID NO: 16418 - RNA, 36 nt, Artificial Sequence
  Description of Artificial Sequence:  Enzymatic Nucleic Acid
cuuguugauggcaugcacuaugcgcgaauuccaaag

SEQ ID NO: 16419 - RNA, 36 nt, Artificial Sequence
  Description of Artificial Sequence:  Enzymatic Nucleic Acid
uccugugauggcaugcacuaugcgcgaaguugcugu

SEQ ID NO: 16420 - RNA, 36 nt, Artificial Sequence
  Description of Artificial Sequence:  Enzymatic Nucleic Acid
ucuuuugauggcaugcacuaugcgcgaacauuuuga

SEQ ID NO: 16421 - RNA, 36 nt, Artificial Sequence
  Description of Artificial Sequence:  Enzymatic Nucleic Acid
augcuugauggcaugcacuaugcgcgacuguguguu

SEQ ID NO: 16422 - RNA, 36 nt, Artificial Sequence
  Description of Artificial Sequence:  Enzymatic Nucleic Acid
gagcuugauggcaugcacuaugcgcggaugcucacu

SEQ ID NO: 16423 - RNA, 36 nt, Artificial Sequence
  Description of Artificial Sequence:  Enzymatic Nucleic Acid
gaguuugauggcaugcacuaugcgcgagacaugaga

SEQ ID NO: 16424 - RNA, 36 nt, Artificial Sequence
  Description of Artificial Sequence:  Enzymatic Nucleic Acid
acaggugauggcaugcacuaugcgcgaccuagaagg

SEQ ID NO: 16425 - RNA, 36 nt, Artificial Sequence
  Description of Artificial Sequence:  Enzymatic Nucleic Acid
acaauugauggcaugcacuaugcgcgaccaugagug

SEQ ID NO: 16426 - RNA, 36 nt, Artificial Sequence
  Description of Artificial Sequence:  Enzymatic Nucleic Acid
auuugugauggcaugcacuaugcgcgagaauuccac

SEQ ID NO: 16427 - RNA, 36 nt, Artificial Sequence
  Description of Artificial Sequence:  Enzymatic Nucleic Acid
cuccuugauggcaugcacuaugcgcgagguaagugg

SEQ ID NO: 16428 - RNA, 36 nt, Artificial Sequence
  Description of Artificial Sequence:  Enzymatic Nucleic Acid
aaauuugauggcaugcacuaugcgcgauuucucuug

SEQ ID NO: 16429 - RNA, 36 nt, Artificial Sequence
  Description of Artificial Sequence:  Enzymatic Nucleic Acid
ggaauugauggcaugcacuaugcgcggugccccuuu

SEQ ID NO: 16430 - RNA, 36 nt, Artificial Sequence
  Description of Artificial Sequence:  Enzymatic Nucleic Acid
cguuuugauggcaugcacuaugcgcgagauccacag

SEQ ID NO: 16431 - RNA, 36 nt, Artificial Sequence
  Description of Artificial Sequence:  Enzymatic Nucleic Acid
ccaagugauggcaugcacuaugcgcggccguuucag

SEQ ID NO: 16432 - RNA, 36 nt, Artificial Sequence
  Description of Artificial Sequence:  Enzymatic Nucleic Acid
uacauugauggcaugcacuaugcgcgacugagggac

SEQ ID NO: 16433 - RNA, 36 nt, Artificial Sequence
  Description of Artificial Sequence:  Enzymatic Nucleic Acid
aucuuugauggcaugcacuaugcgcgaggagcuucc

SEQ ID NO: 16434 - RNA, 36 nt, Artificial Sequence
  Description of Artificial Sequence:  Enzymatic Nucleic Acid
aagguugauggcaugcacuaugcgcgaggaaguccu

SEQ ID NO: 16435 - RNA, 36 nt, Artificial Sequence
  Description of Artificial Sequence:  Enzymatic Nucleic Acid
uuucgugauggcaugcacuaugcgcggaugccaaga

SEQ ID NO: 16436 - RNA, 36 nt, Artificial Sequence
  Description of Artificial Sequence:  Enzymatic Nucleic Acid
acuuuugauggcaugcacuaugcgcggcgaugccaa

SEQ ID NO: 16437 - RNA, 36 nt, Artificial Sequence
  Description of Artificial Sequence:  Enzymatic Nucleic Acid
uauuuugauggcaugcacuaugcgcggugccgccag

SEQ ID NO: 16438 - RNA, 36 nt, Artificial Sequence
  Description of Artificial Sequence:  Enzymatic Nucleic Acid
aaaguugauggcaugcacuaugcgcgacagauuuua

SEQ ID NO: 16439 - RNA, 36 nt, Artificial Sequence
  Description of Artificial Sequence:  Enzymatic Nucleic Acid
gcgagugauggcaugcacuaugcgcgaucuccuuuu

SEQ ID NO: 16440 - RNA, 36 nt, Artificial Sequence
  Description of Artificial Sequence:  Enzymatic Nucleic Acid
ggaggugauggcaugcacuaugcgcggagcaucucc

SEQ ID NO: 16441 - RNA, 36 nt, Artificial Sequence
  Description of Artificial Sequence:  Enzymatic Nucleic Acid
cauuuugauggcaugcacuaugcgcgaaagggaggc

SEQ ID NO: 16442 - RNA, 36 nt, Artificial Sequence
  Description of Artificial Sequence:  Enzymatic Nucleic Acid
ucuguugauggcaugcacuaugcgcgaaaaauuguu

SEQ ID NO: 16443 - RNA, 36 nt, Artificial Sequence
  Description of Artificial Sequence:  Enzymatic Nucleic Acid
gacguugauggcaugcacuaugcgcgacucuggauu

SEQ ID NO: 16444 - RNA, 36 nt, Artificial Sequence
  Description of Artificial Sequence:  Enzymatic Nucleic Acid
cacagugauggcaugcacuaugcgcgaaaacaccaa

SEQ ID NO: 16445 - RNA, 36 nt, Artificial Sequence
  Description of Artificial Sequence:  Enzymatic Nucleic Acid
agaagugauggcaugcacuaugcgcgaccuaaggaa

SEQ ID NO: 16446 - RNA, 36 nt, Artificial Sequence
  Description of Artificial Sequence:  Enzymatic Nucleic Acid
uucauugauggcaugcacuaugcgcgaaucuuuacc

SEQ ID NO: 16447 - RNA, 36 nt, Artificial Sequence
  Description of Artificial Sequence:  Enzymatic Nucleic Acid
uucuuugauggcaugcacuaugcgcgaucaaucuuu

SEQ ID NO: 16448 - RNA, 36 nt, Artificial Sequence
  Description of Artificial Sequence:  Enzymatic Nucleic Acid
ucaauugauggcaugcacuaugcgcggccuacaaaa

SEQ ID NO: 16449 - RNA, 36 nt, Artificial Sequence
  Description of Artificial Sequence:  Enzymatic Nucleic Acid
ucuuuugauggcaugcacuaugcgcgaaucgccuac

SEQ ID NO: 16450 - RNA, 36 nt, Artificial Sequence
  Description of Artificial Sequence:  Enzymatic Nucleic Acid
gcccuugauggcaugcacuaugcgcgauucuaguuc

SEQ ID NO: 16451 - RNA, 36 nt, Artificial Sequence
  Description of Artificial Sequence:  Enzymatic Nucleic Acid
auaauugauggcaugcacuaugcgcgaggggcccuc

SEQ ID NO: 16452 - RNA, 36 nt, Artificial Sequence
  Description of Artificial Sequence:  Enzymatic Nucleic Acid
uccagugauggcaugcacuaugcgcgauggucuggu

SEQ ID NO: 16453 - RNA, 36 nt, Artificial Sequence
  Description of Artificial Sequence:  Enzymatic Nucleic Acid
gcuugugauggcaugcacuaugcgcgaagagauuuc

SEQ ID NO: 16454 - RNA, 36 nt, Artificial Sequence
  Description of Artificial Sequence:  Enzymatic Nucleic Acid
cugagugauggcaugcacuaugcgcgauuagcuugc

SEQ ID NO: 16455 - RNA, 36 nt, Artificial Sequence
  Description of Artificial Sequence:  Enzymatic Nucleic Acid
gauauugauggcaugcacuaugcgcgggaagaacaa

SEQ ID NO: 16456 - RNA, 36 nt, Artificial Sequence
  Description of Artificial Sequence:  Enzymatic Nucleic Acid
augcuugauggcaugcacuaugcgcgaaagucucug

SEQ ID NO: 16457 - RNA, 36 nt, Artificial Sequence
  Description of Artificial Sequence:  Enzymatic Nucleic Acid
guaggugauggcaugcacuaugcgcgagagagaguc

SEQ ID NO: 16458 - RNA, 36 nt, Artificial Sequence
  Description of Artificial Sequence:  Enzymatic Nucleic Acid
gggguugauggcaugcacuaugcgcgacauacuucc

SEQ ID NO: 16459 - RNA, 36 nt, Artificial Sequence
  Description of Artificial Sequence:  Enzymatic Nucleic Acid
guuguugauggcaugcacuaugcgcgauaauggaau

SEQ ID NO: 16460 - RNA, 36 nt, Artificial Sequence
  Description of Artificial Sequence:  Enzymatic Nucleic Acid
uucugugauggcaugcacuaugcgcgagauacugac

SEQ ID NO: 16461 - RNA, 36 nt, Artificial Sequence
  Description of Artificial Sequence:  Enzymatic Nucleic Acid
ucuuuugauggcaugcacuaugcgcggcuuacuguu

SEQ ID NO: 16462 - RNA, 36 nt, Artificial Sequence
  Description of Artificial Sequence:  Enzymatic Nucleic Acid
acacuugauggcaugcacuaugcgcgacaggccggc

SEQ ID NO: 16463 - RNA, 36 nt, Artificial Sequence
  Description of Artificial Sequence:  Enzymatic Nucleic Acid
aucuuugauggcaugcacuaugcgcgaaauguuuuu

SEQ ID NO: 16464 - RNA, 36 nt, Artificial Sequence
  Description of Artificial Sequence:  Enzymatic Nucleic Acid
guuguugauggcaugcacuaugcgcgaucugggauu

SEQ ID NO: 16465 - RNA, 36 nt, Artificial Sequence
  Description of Artificial Sequence:  Enzymatic Nucleic Acid
ugaggugauggcaugcacuaugcgcgaagaaccaua

SEQ ID NO: 16466 - RNA, 36 nt, Artificial Sequence
  Description of Artificial Sequence:  Enzymatic Nucleic Acid
guuuuugauggcaugcacuaugcgcgagcucuucug

SEQ ID NO: 16467 - RNA, 36 nt, Artificial Sequence
  Description of Artificial Sequence:  Enzymatic Nucleic Acid
cugggugauggcaugcacuaugcgcgaccauuccac

SEQ ID NO: 16468 - RNA, 36 nt, Artificial Sequence
  Description of Artificial Sequence:  Enzymatic Nucleic Acid
gccuuugauggcaugcacuaugcgcgagaugccaca

SEQ ID NO: 16469 - RNA, 36 nt, Artificial Sequence
  Description of Artificial Sequence:  Enzymatic Nucleic Acid
gucauugauggcaugcacuaugcgcgggagugauau

SEQ ID NO: 16470 - RNA, 36 nt, Artificial Sequence
  Description of Artificial Sequence:  Enzymatic Nucleic Acid
uguguugauggcaugcacuaugcgcgaucggaguga

SEQ ID NO: 16471 - RNA, 36 nt, Artificial Sequence
  Description of Artificial Sequence:  Enzymatic Nucleic Acid
uuccuugauggcaugcacuaugcgcgacuggaguac

SEQ ID NO: 16472 - RNA, 36 nt, Artificial Sequence
  Description of Artificial Sequence:  Enzymatic Nucleic Acid
ucuauugauggcaugcacuaugcgcgagcuuuaaaa

SEQ ID NO: 16473 - RNA, 36 nt, Artificial Sequence
  Description of Artificial Sequence:  Enzymatic Nucleic Acid
guuugugauggcaugcacuaugcgcgacuccaaucu

SEQ ID NO: 16474 - RNA, 36 nt, Artificial Sequence
  Description of Artificial Sequence:  Enzymatic Nucleic Acid
cguguugauggcaugcacuaugcgcgaggcuggaga

SEQ ID NO: 16475 - RNA, 36 nt, Artificial Sequence
  Description of Artificial Sequence:  Enzymatic Nucleic Acid
gagcuugauggcaugcacuaugcgcgaguguggucc

SEQ ID NO: 16476 - RNA, 36 nt, Artificial Sequence
  Description of Artificial Sequence:  Enzymatic Nucleic Acid
ccucuugauggcaugcacuaugcgcgaugugauguc

SEQ ID NO: 16477 - RNA, 36 nt, Artificial Sequence
  Description of Artificial Sequence:  Enzymatic Nucleic Acid
cugagugauggcaugcacuaugcgcgagaccucuca

SEQ ID NO: 16478 - RNA, 36 nt, Artificial Sequence
  Description of Artificial Sequence:  Enzymatic Nucleic Acid
cacuuugauggcaugcacuaugcgcgaaaaucugag

SEQ ID NO: 16479 - RNA, 36 nt, Artificial Sequence
  Description of Artificial Sequence:  Enzymatic Nucleic Acid
aaaugugauggcaugcacuaugcgcgggcuacuucc

SEQ ID NO: 16480 - RNA, 36 nt, Artificial Sequence
  Description of Artificial Sequence:  Enzymatic Nucleic Acid
aaaauugauggcaugcacuaugcgcgaaaugcggcu

SEQ ID NO: 16481 - RNA, 36 nt, Artificial Sequence
  Description of Artificial Sequence:  Enzymatic Nucleic Acid
guuguugauggcaugcacuaugcgcggaaaugaaaa

SEQ ID NO: 16482 - RNA, 36 nt, Artificial Sequence
  Description of Artificial Sequence:  Enzymatic Nucleic Acid
cccugugauggcaugcacuaugcgcgaguccgaggu

SEQ ID NO: 16483 - DNA, 31 bp, Artificial Sequence
  Description of Artificial Sequence:  Enzymatic Nucleic Acid
gggaggagggctagctacaacgacgagagga

SEQ ID NO: 16484 - DNA, 31 bp, Artificial Sequence
  Description of Artificial Sequence:  Enzymatic Nucleic Acid
cgccgctgggctagctacaacgacggggagg

SEQ ID NO: 16485 - DNA, 31 bp, Artificial Sequence
  Description of Artificial Sequence:  Enzymatic Nucleic Acid
cgccgccgggctagctacaacgatgccgggg

SEQ ID NO: 16486 - DNA, 31 bp, Artificial Sequence
  Description of Artificial Sequence:  Enzymatic Nucleic Acid
agccgccgggctagctacaacgacgctgccg

SEQ ID NO: 16487 - DNA, 31 bp, Artificial Sequence
  Description of Artificial Sequence:  Enzymatic Nucleic Acid
ccgagccgggctagctacaacgacgccgctg

SEQ ID NO: 16488 - DNA, 31 bp, Artificial Sequence
  Description of Artificial Sequence:  Enzymatic Nucleic Acid
gctccgagggctagctacaacgacgccgccg

SEQ ID NO: 16489 - DNA, 31 bp, Artificial Sequence
  Description of Artificial Sequence:  Enzymatic Nucleic Acid
ggagcccgggctagctacaacgatccgagcc

SEQ ID NO: 16490 - DNA, 31 bp, Artificial Sequence
  Description of Artificial Sequence:  Enzymatic Nucleic Acid
ccccggagggctagctacaacgaccgctccg

SEQ ID NO: 16491 - DNA, 31 bp, Artificial Sequence
  Description of Artificial Sequence:  Enzymatic Nucleic Acid
cacccgagggctagctacaacgacccggagc

SEQ ID NO: 16492 - DNA, 31 bp, Artificial Sequence
  Description of Artificial Sequence:  Enzymatic Nucleic Acid
ccgctgcaggctagctacaacgaccgagccc

SEQ ID NO: 16493 - DNA, 31 bp, Artificial Sequence
  Description of Artificial Sequence:  Enzymatic Nucleic Acid
ggccgctgggctagctacaacgaacccgagc

SEQ ID NO: 16494 - DNA, 31 bp, Artificial Sequence
  Description of Artificial Sequence:  Enzymatic Nucleic Acid
gctggccgggctagctacaacgatgcacccg

SEQ ID NO: 16495 - DNA, 31 bp, Artificial Sequence
  Description of Artificial Sequence:  Enzymatic Nucleic Acid
cccgctggggctagctacaacgacgctgcac

SEQ ID NO: 16496 - DNA, 31 bp, Artificial Sequence
  Description of Artificial Sequence:  Enzymatic Nucleic Acid
caggcccgggctagctacaacgatggccgct

SEQ ID NO: 16497 - DNA, 31 bp, Artificial Sequence
  Description of Artificial Sequence:  Enzymatic Nucleic Acid
ccgccaggggctagctacaacgaccgctggc

SEQ ID NO: 16498 - DNA, 31 bp, Artificial Sequence
  Description of Artificial Sequence:  Enzymatic Nucleic Acid
cctcgccgggctagctacaacgacaggcccg

SEQ ID NO: 16499 - DNA, 31 bp, Artificial Sequence
  Description of Artificial Sequence:  Enzymatic Nucleic Acid
aatcctcgggctagctacaacgacgccaggc

SEQ ID NO: 16500 - DNA, 31 bp, Artificial Sequence
  Description of Artificial Sequence:  Enzymatic Nucleic Acid
ccgggtaaggctagctacaacgacctcgccg

SEQ ID NO: 16501 - DNA, 31 bp, Artificial Sequence
  Description of Artificial Sequence:  Enzymatic Nucleic Acid
tccccgggggctagctacaacgaaatcctcg

SEQ ID NO: 16502 - DNA, 31 bp, Artificial Sequence
  Description of Artificial Sequence:  Enzymatic Nucleic Acid
gacaaccaggctagctacaacgattccccgg

SEQ ID NO: 16503 - DNA, 31 bp, Artificial Sequence
  Description of Artificial Sequence:  Enzymatic Nucleic Acid
ggagacaaggctagctacaacgacacttccc

SEQ ID NO: 16504 - DNA, 31 bp, Artificial Sequence
  Description of Artificial Sequence:  Enzymatic Nucleic Acid
ccaggagaggctagctacaacgaaaccactt

SEQ ID NO: 16505 - DNA, 31 bp, Artificial Sequence
  Description of Artificial Sequence:  Enzymatic Nucleic Acid
ggctccagggctagctacaacgacaggagac

SEQ ID NO: 16506 - DNA, 31 bp, Artificial Sequence
  Description of Artificial Sequence:  Enzymatic Nucleic Acid
tctcgcggggctagctacaacgatccagcca

SEQ ID NO: 16507 - DNA, 31 bp, Artificial Sequence
  Description of Artificial Sequence:  Enzymatic Nucleic Acid
ccgtctcgggctagctacaacgaggctccag

SEQ ID NO: 16508 - DNA, 31 bp, Artificial Sequence
  Description of Artificial Sequence:  Enzymatic Nucleic Acid
agcgcccgggctagctacaacgactcgcggc

SEQ ID NO: 16509 - DNA, 31 bp, Artificial Sequence
  Description of Artificial Sequence:  Enzymatic Nucleic Acid
cctgagcgggctagctacaacgaccgtctcg

SEQ ID NO: 16510 - DNA, 31 bp, Artificial Sequence
  Description of Artificial Sequence:  Enzymatic Nucleic Acid
gccctgagggctagctacaacgagcccgtct

SEQ ID NO: 16511 - DNA, 31 bp, Artificial Sequence
  Description of Artificial Sequence:  Enzymatic Nucleic Acid
gccccgcgggctagctacaacgacctgagcg

SEQ ID NO: 16512 - DNA, 31 bp, Artificial Sequence
  Description of Artificial Sequence:  Enzymatic Nucleic Acid
cggccccgggctagctacaacgagccctgag

SEQ ID NO: 16513 - DNA, 31 bp, Artificial Sequence
  Description of Artificial Sequence:  Enzymatic Nucleic Acid
gccgccggggctagctacaacgacccgcgcc

SEQ ID NO: 16514 - DNA, 31 bp, Artificial Sequence
  Description of Artificial Sequence:  Enzymatic Nucleic Acid
cgccgccgggctagctacaacgacggccccg

SEQ ID NO: 16515 - DNA, 31 bp, Artificial Sequence
  Description of Artificial Sequence:  Enzymatic Nucleic Acid
gttcgccgggctagctacaacgacgccggcc

SEQ ID NO: 16516 - DNA, 31 bp, Artificial Sequence
  Description of Artificial Sequence:  Enzymatic Nucleic Acid
ctcgttcgggctagctacaacgacgccgccg

SEQ ID NO: 16517 - DNA, 31 bp, Artificial Sequence
  Description of Artificial Sequence:  Enzymatic Nucleic Acid
tcctctcgggctagctacaacgatcgccgcc

SEQ ID NO: 16518 - DNA, 31 bp, Artificial Sequence
  Description of Artificial Sequence:  Enzymatic Nucleic Acid
agagtccgggctagctacaacgacctctcgt

SEQ ID NO: 16519 - DNA, 31 bp, Artificial Sequence
  Description of Artificial Sequence:  Enzymatic Nucleic Acid
cgccagagggctagctacaacgaccgtcctc

SEQ ID NO: 16520 - DNA, 31 bp, Artificial Sequence
  Description of Artificial Sequence:  Enzymatic Nucleic Acid
cccggccgggctagctacaacgacagagtcc

SEQ ID NO: 16521 - DNA, 31 bp, Artificial Sequence
  Description of Artificial Sequence:  Enzymatic Nucleic Acid
cgacccggggctagctacaacgacgccagag

SEQ ID NO: 16522 - DNA, 31 bp, Artificial Sequence
  Description of Artificial Sequence:  Enzymatic Nucleic Acid
gccaacgaggctagctacaacgaccggccgc

SEQ ID NO: 16523 - DNA, 31 bp, Artificial Sequence
  Description of Artificial Sequence:  Enzymatic Nucleic Acid
ccggccaaggctagctacaacgagacccggc

SEQ ID NO: 16524 - DNA, 31 bp, Artificial Sequence
  Description of Artificial Sequence:  Enzymatic Nucleic Acid
tcccccggggctagctacaacgacaacgacc

SEQ ID NO: 16525 - DNA, 31 bp, Artificial Sequence
  Description of Artificial Sequence:  Enzymatic Nucleic Acid
tgcccgcgggctagctacaacgatcccccgg

SEQ ID NO: 16526 - DNA, 31 bp, Artificial Sequence
  Description of Artificial Sequence:  Enzymatic Nucleic Acid
ggtgcccgggctagctacaacgagctccccc

SEQ ID NO: 16527 - DNA, 31 bp, Artificial Sequence
  Description of Artificial Sequence:  Enzymatic Nucleic Acid
gcccggtgggctagctacaacgaccgcgctc

SEQ ID NO: 16528 - DNA, 31 bp, Artificial Sequence
  Description of Artificial Sequence:  Enzymatic Nucleic Acid
tcgcccggggctagctacaacgagcccgcgc

SEQ ID NO: 16529 - DNA, 31 bp, Artificial Sequence
  Description of Artificial Sequence:  Enzymatic Nucleic Acid
cctgctcgggctagctacaacgaccggtgcc

SEQ ID NO: 16530 - DNA, 31 bp, Artificial Sequence
  Description of Artificial Sequence:  Enzymatic Nucleic Acid
gcggcctgggctagctacaacgatcgcccgg

SEQ ID NO: 16531 - DNA, 31 bp, Artificial Sequence
  Description of Artificial Sequence:  Enzymatic Nucleic Acid
cgacgcggggctagctacaacgactgctcgc

SEQ ID NO: 16532 - DNA, 31 bp, Artificial Sequence
  Description of Artificial Sequence:  Enzymatic Nucleic Acid
gcgcgacgggctagctacaacgaggcctgct

SEQ ID NO: 16533 - DNA, 31 bp, Artificial Sequence
  Description of Artificial Sequence:  Enzymatic Nucleic Acid
gagcgcgaggctagctacaacgagcggcctg

SEQ ID NO: 16534 - DNA, 31 bp, Artificial Sequence
  Description of Artificial Sequence:  Enzymatic Nucleic Acid
ggtgagcgggctagctacaacgagacgcggc

SEQ ID NO: 16535 - DNA, 31 bp, Artificial Sequence
  Description of Artificial Sequence:  Enzymatic Nucleic Acid
atggtgagggctagctacaacgagcgacgcg

SEQ ID NO: 16536 - DNA, 31 bp, Artificial Sequence
  Description of Artificial Sequence:  Enzymatic Nucleic Acid
gaccatggggctagctacaacgagagcgcga

SEQ ID NO: 16537 - DNA, 31 bp, Artificial Sequence
  Description of Artificial Sequence:  Enzymatic Nucleic Acid
gctgaccaggctagctacaacgaggtgagcg

SEQ ID NO: 16538 - DNA, 31 bp, Artificial Sequence
  Description of Artificial Sequence:  Enzymatic Nucleic Acid
gtagctgaggctagctacaacgacatggtga

SEQ ID NO: 16539 - DNA, 31 bp, Artificial Sequence
  Description of Artificial Sequence:  Enzymatic Nucleic Acid
cccagtagggctagctacaacgatgaccatg

SEQ ID NO: 16540 - DNA, 31 bp, Artificial Sequence
  Description of Artificial Sequence:  Enzymatic Nucleic Acid
tgtcccagggctagctacaacgaagctgacc

SEQ ID NO: 16541 - DNA, 31 bp, Artificial Sequence
  Description of Artificial Sequence:  Enzymatic Nucleic Acid
ccccggtgggctagctacaacgacccagtag

SEQ ID NO: 16542 - DNA, 31 bp, Artificial Sequence
  Description of Artificial Sequence:  Enzymatic Nucleic Acid
gaccccggggctagctacaacgagtcccagt

SEQ ID NO: 16543 - DNA, 31 bp, Artificial Sequence
  Description of Artificial Sequence:  Enzymatic Nucleic Acid
cagcaggaggctagctacaacgacccggtgt

SEQ ID NO: 16544 - DNA, 31 bp, Artificial Sequence
  Description of Artificial Sequence:  Enzymatic Nucleic Acid
gcgcacagggctagctacaacgaaggacccc

SEQ ID NO: 16545 - DNA, 31 bp, Artificial Sequence
  Description of Artificial Sequence:  Enzymatic Nucleic Acid
agcgcgcaggctagctacaacgaagcaggac

SEQ ID NO: 16546 - DNA, 31 bp, Artificial Sequence
  Description of Artificial Sequence:  Enzymatic Nucleic Acid
gcagcgcgggctagctacaacgaacagcagg

SEQ ID NO: 16547 - DNA, 31 bp, Artificial Sequence
  Description of Artificial Sequence:  Enzymatic Nucleic Acid
gagcagcgggctagctacaacgagcacagca

SEQ ID NO: 16548 - DNA, 31 bp, Artificial Sequence
  Description of Artificial Sequence:  Enzymatic Nucleic Acid
ctgagcagggctagctacaacgagcgcacag

SEQ ID NO: 16549 - DNA, 31 bp, Artificial Sequence
  Description of Artificial Sequence:  Enzymatic Nucleic Acid
cagctgagggctagctacaacgaagcgcgca

SEQ ID NO: 16550 - DNA, 31 bp, Artificial Sequence
  Description of Artificial Sequence:  Enzymatic Nucleic Acid
gcagacagggctagctacaacgatgagcagc

SEQ ID NO: 16551 - DNA, 31 bp, Artificial Sequence
  Description of Artificial Sequence:  Enzymatic Nucleic Acid
gaagcagaggctagctacaacgaagctgagc

SEQ ID NO: 16552 - DNA, 31 bp, Artificial Sequence
  Description of Artificial Sequence:  Enzymatic Nucleic Acid
gtgagaagggctagctacaacgaagacagct

SEQ ID NO: 16553 - DNA, 31 bp, Artificial Sequence
  Description of Artificial Sequence:  Enzymatic Nucleic Acid
agatcctgggctagctacaacgagagaagca

SEQ ID NO: 16554 - DNA, 31 bp, Artificial Sequence
  Description of Artificial Sequence:  Enzymatic Nucleic Acid
gaactagaggctagctacaacgacctgtgag

SEQ ID NO: 16555 - DNA, 31 bp, Artificial Sequence
  Description of Artificial Sequence:  Enzymatic Nucleic Acid
aacctgaaggctagctacaacgatagatcct

SEQ ID NO: 16556 - DNA, 31 bp, Artificial Sequence
  Description of Artificial Sequence:  Enzymatic Nucleic Acid
attttgaaggctagctacaacgactgaacta

SEQ ID NO: 16557 - DNA, 31 bp, Artificial Sequence
  Description of Artificial Sequence:  Enzymatic Nucleic Acid
tcttttaaggctagctacaacgatttgaacc

SEQ ID NO: 16558 - DNA, 31 bp, Artificial Sequence
  Description of Artificial Sequence:  Enzymatic Nucleic Acid
gttcaggaggctagctacaacgacttttaat

SEQ ID NO: 16559 - DNA, 31 bp, Artificial Sequence
  Description of Artificial Sequence:  Enzymatic Nucleic Acid
aaactcagggctagctacaacgatcaggatc

SEQ ID NO: 16560 - DNA, 31 bp, Artificial Sequence
  Description of Artificial Sequence:  Enzymatic Nucleic Acid
cttttaaaggctagctacaacgatcagttca

SEQ ID NO: 16561 - DNA, 31 bp, Artificial Sequence
  Description of Artificial Sequence:  Enzymatic Nucleic Acid
gctgggtgggctagctacaacgacttttaaa

SEQ ID NO: 16562 - DNA, 31 bp, Artificial Sequence
  Description of Artificial Sequence:  Enzymatic Nucleic Acid
gtgctgggggctagctacaacgagcctttta

SEQ ID NO: 16563 - DNA, 31 bp, Artificial Sequence
  Description of Artificial Sequence:  Enzymatic Nucleic Acid
atgatgtgggctagctacaacgatgggtgcc

SEQ ID NO: 16564 - DNA, 31 bp, Artificial Sequence
  Description of Artificial Sequence:  Enzymatic Nucleic Acid
gcatgatgggctagctacaacgagctgggtg

SEQ ID NO: 16565 - DNA, 31 bp, Artificial Sequence
  Description of Artificial Sequence:  Enzymatic Nucleic Acid
ttgcatgaggctagctacaacgagtgctggg

SEQ ID NO: 16566 - DNA, 31 bp, Artificial Sequence
  Description of Artificial Sequence:  Enzymatic Nucleic Acid
tgcttgcaggctagctacaacgagatgtgct

SEQ ID NO: 16567 - DNA, 31 bp, Artificial Sequence
  Description of Artificial Sequence:  Enzymatic Nucleic Acid
cctgcttgggctagctacaacgaatgatgtg

SEQ ID NO: 16568 - DNA, 31 bp, Artificial Sequence
  Description of Artificial Sequence:  Enzymatic Nucleic Acid
ctggcctgggctagctacaacgattgcatga

SEQ ID NO: 16569 - DNA, 31 bp, Artificial Sequence
  Description of Artificial Sequence:  Enzymatic Nucleic Acid
gtgtctggggctagctacaacgactgcttgc

SEQ ID NO: 16570 - DNA, 31 bp, Artificial Sequence
  Description of Artificial Sequence:  Enzymatic Nucleic Acid
atgcagtgggctagctacaacgactggcctg

SEQ ID NO: 16571 - DNA, 31 bp, Artificial Sequence
  Description of Artificial Sequence:  Enzymatic Nucleic Acid
agatgcagggctagctacaacgagtctggcc

SEQ ID NO: 16572 - DNA, 31 bp, Artificial Sequence
  Description of Artificial Sequence:  Enzymatic Nucleic Acid
tggagatgggctagctacaacgaagtgtctg

SEQ ID NO: 16573 - DNA, 31 bp, Artificial Sequence
  Description of Artificial Sequence:  Enzymatic Nucleic Acid
attggagaggctagctacaacgagcagtgtc

SEQ ID NO: 16574 - DNA, 31 bp, Artificial Sequence
  Description of Artificial Sequence:  Enzymatic Nucleic Acid
cccctgcaggctagctacaacgatggagatg

SEQ ID NO: 16575 - DNA, 31 bp, Artificial Sequence
  Description of Artificial Sequence:  Enzymatic Nucleic Acid
cccccctgggctagctacaacgaattggaga

SEQ ID NO: 16576 - DNA, 31 bp, Artificial Sequence
  Description of Artificial Sequence:  Enzymatic Nucleic Acid
atgggctgggctagctacaacgattcccccc

SEQ ID NO: 16577 - DNA, 31 bp, Artificial Sequence
  Description of Artificial Sequence:  Enzymatic Nucleic Acid
tttatgggggctagctacaacgatgcttccc

SEQ ID NO: 16578 - DNA, 31 bp, Artificial Sequence
  Description of Artificial Sequence:  Enzymatic Nucleic Acid
accatttaggctagctacaacgagggctgct

SEQ ID NO: 16579 - DNA, 31 bp, Artificial Sequence
  Description of Artificial Sequence:  Enzymatic Nucleic Acid
aaagaccaggctagctacaacgattatgggc

SEQ ID NO: 16580 - DNA, 31 bp, Artificial Sequence
  Description of Artificial Sequence:  Enzymatic Nucleic Acid
ggcaaagaggctagctacaacgacatttatg

SEQ ID NO: 16581 - DNA, 31 bp, Artificial Sequence
  Description of Artificial Sequence:  Enzymatic Nucleic Acid
atttcaggggctagctacaacgaaaagacca

SEQ ID NO: 16582 - DNA, 31 bp, Artificial Sequence
  Description of Artificial Sequence:  Enzymatic Nucleic Acid
actcaccaggctagctacaacgattcaggca

SEQ ID NO: 16583 - DNA, 31 bp, Artificial Sequence
  Description of Artificial Sequence:  Enzymatic Nucleic Acid
cttactcaggctagctacaacgacatttcag

SEQ ID NO: 16584 - DNA, 31 bp, Artificial Sequence
  Description of Artificial Sequence:  Enzymatic Nucleic Acid
tttccttaggctagctacaacgatcaccatt

SEQ ID NO: 16585 - DNA, 31 bp, Artificial Sequence
  Description of Artificial Sequence:  Enzymatic Nucleic Acid
gcctttcgggctagctacaacgatttcctta

SEQ ID NO: 16586 - DNA, 31 bp, Artificial Sequence
  Description of Artificial Sequence:  Enzymatic Nucleic Acid
atgctcagggctagctacaacgactttcgct

SEQ ID NO: 16587 - DNA, 31 bp, Artificial Sequence
  Description of Artificial Sequence:  Enzymatic Nucleic Acid
tagttatgggctagctacaacgatcagcctt

SEQ ID NO: 16588 - DNA, 31 bp, Artificial Sequence
  Description of Artificial Sequence:  Enzymatic Nucleic Acid
tttagttaggctagctacaacgagctcagcc

SEQ ID NO: 16589 - DNA, 31 bp, Artificial Sequence
  Description of Artificial Sequence:  Enzymatic Nucleic Acid
agatttagggctagctacaacgatatgctca

SEQ ID NO: 16590 - DNA, 31 bp, Artificial Sequence
  Description of Artificial Sequence:  Enzymatic Nucleic Acid
caggcagaggctagctacaacgattagttat

SEQ ID NO: 16591 - DNA, 31 bp, Artificial Sequence
  Description of Artificial Sequence:  Enzymatic Nucleic Acid
tccacaggggctagctacaacgaagatttag

SEQ ID NO: 16592 - DNA, 31 bp, Artificial Sequence
  Description of Artificial Sequence:  Enzymatic Nucleic Acid
ttcttccaggctagctacaacgaaggcagat

SEQ ID NO: 16593 - DNA, 31 bp, Artificial Sequence
  Description of Artificial Sequence:  Enzymatic Nucleic Acid
gtttgccaggctagctacaacgattcttcca

SEQ ID NO: 16594 - DNA, 31 bp, Artificial Sequence
  Description of Artificial Sequence:  Enzymatic Nucleic Acid
attgtttgggctagctacaacgacatttctt

SEQ ID NO: 16595 - DNA, 31 bp, Artificial Sequence
  Description of Artificial Sequence:  Enzymatic Nucleic Acid
cagaattgggctagctacaacgattgccatt

SEQ ID NO: 16596 - DNA, 31 bp, Artificial Sequence
  Description of Artificial Sequence:  Enzymatic Nucleic Acid
ctgcagaaggctagctacaacgatgtttgcc

SEQ ID NO: 16597 - DNA, 31 bp, Artificial Sequence
  Description of Artificial Sequence:  Enzymatic Nucleic Acid
aagtactgggctagctacaacgaagaattgt

SEQ ID NO: 16598 - DNA, 31 bp, Artificial Sequence
  Description of Artificial Sequence:  Enzymatic Nucleic Acid
ttaaagtaggctagctacaacgatgcagaat

SEQ ID NO: 16599 - DNA, 31 bp, Artificial Sequence
  Description of Artificial Sequence:  Enzymatic Nucleic Acid
ggttaaagggctagctacaacgaactgcaga

SEQ ID NO: 16600 - DNA, 31 bp, Artificial Sequence
  Description of Artificial Sequence:  Enzymatic Nucleic Acid
gttcaaggggctagctacaacgataaagtac

SEQ ID NO: 16601 - DNA, 31 bp, Artificial Sequence
  Description of Artificial Sequence:  Enzymatic Nucleic Acid
gagctgtgggctagctacaacgatcaaggtt

SEQ ID NO: 16602 - DNA, 31 bp, Artificial Sequence
  Description of Artificial Sequence:  Enzymatic Nucleic Acid
ttgagctgggctagctacaacgagttcaagg

SEQ ID NO: 16603 - DNA, 31 bp, Artificial Sequence
  Description of Artificial Sequence:  Enzymatic Nucleic Acid
tgcttgagggctagctacaacgatgtgttca

SEQ ID NO: 16604 - DNA, 31 bp, Artificial Sequence
  Description of Artificial Sequence:  Enzymatic Nucleic Acid
gtggtttgggctagctacaacgattgagctg

SEQ ID NO: 16605 - DNA, 31 bp, Artificial Sequence
  Description of Artificial Sequence:  Enzymatic Nucleic Acid
cagtgtggggctagctacaacgattgcttga

SEQ ID NO: 16606 - DNA, 31 bp, Artificial Sequence
  Description of Artificial Sequence:  Enzymatic Nucleic Acid
agccagtgggctagctacaacgaggtttgct

SEQ ID NO: 16607 - DNA, 31 bp, Artificial Sequence
  Description of Artificial Sequence:  Enzymatic Nucleic Acid
gaagccagggctagctacaacgagtggtttg

SEQ ID NO: 16608 - DNA, 31 bp, Artificial Sequence
  Description of Artificial Sequence:  Enzymatic Nucleic Acid
tgtagaagggctagctacaacgacagtgtgg

SEQ ID NO: 16609 - DNA, 31 bp, Artificial Sequence
  Description of Artificial Sequence:  Enzymatic Nucleic Acid
tgcagctgggctagctacaacgaagaagcca

SEQ ID NO: 16610 - DNA, 31 bp, Artificial Sequence
  Description of Artificial Sequence:  Enzymatic Nucleic Acid
atttgcagggctagctacaacgatgtagaag

SEQ ID NO: 16611 - DNA, 31 bp, Artificial Sequence
  Description of Artificial Sequence:  Enzymatic Nucleic Acid
gatatttgggctagctacaacgaagctgtag

SEQ ID NO: 16612 - DNA, 31 bp, Artificial Sequence
  Description of Artificial Sequence:  Enzymatic Nucleic Acid
gctagataggctagctacaacgattgcagct

SEQ ID NO: 16613 - DNA, 31 bp, Artificial Sequence
  Description of Artificial Sequence:  Enzymatic Nucleic Acid
cagctagaggctagctacaacgaatttgcag

SEQ ID NO: 16614 - DNA, 31 bp, Artificial Sequence
  Description of Artificial Sequence:  Enzymatic Nucleic Acid
aggtacagggctagctacaacgatagatatt

SEQ ID NO: 16615 - DNA, 31 bp, Artificial Sequence
  Description of Artificial Sequence:  Enzymatic Nucleic Acid
agtaggtaggctagctacaacgaagctagat

SEQ ID NO: 16616 - DNA, 31 bp, Artificial Sequence
  Description of Artificial Sequence:  Enzymatic Nucleic Acid
gaagtaggggctagctacaacgaacagctag

SEQ ID NO: 16617 - DNA, 31 bp, Artificial Sequence
  Description of Artificial Sequence:  Enzymatic Nucleic Acid
ctttgaagggctagctacaacgaaggtacag

SEQ ID NO: 16618 - DNA, 31 bp, Artificial Sequence
  Description of Artificial Sequence:  Enzymatic Nucleic Acid
agattctgggctagctacaacgattccttct

SEQ ID NO: 16619 - DNA, 31 bp, Artificial Sequence
  Description of Artificial Sequence:  Enzymatic Nucleic Acid
attgcagaggctagctacaacgatctgtttc

SEQ ID NO: 16620 - DNA, 31 bp, Artificial Sequence
  Description of Artificial Sequence:  Enzymatic Nucleic Acid
atagattgggctagctacaacgaagattctg

SEQ ID NO: 16621 - DNA, 31 bp, Artificial Sequence
  Description of Artificial Sequence:  Enzymatic Nucleic Acid
tatatagaggctagctacaacgatgcagatt

SEQ ID NO: 16622 - DNA, 31 bp, Artificial Sequence
  Description of Artificial Sequence:  Enzymatic Nucleic Acid
taaatataggctagctacaacgaagattgca

SEQ ID NO: 16623 - DNA, 31 bp, Artificial Sequence
  Description of Artificial Sequence:  Enzymatic Nucleic Acid
aataaataggctagctacaacgaatagattg

SEQ ID NO: 16624 - DNA, 31 bp, Artificial Sequence
  Description of Artificial Sequence:  Enzymatic Nucleic Acid
ctaataaaggctagctacaacgaatatagat

SEQ ID NO: 16625 - DNA, 31 bp, Artificial Sequence
  Description of Artificial Sequence:  Enzymatic Nucleic Acid
atcactaaggctagctacaacgaaaatatat

SEQ ID NO: 16626 - DNA, 31 bp, Artificial Sequence
  Description of Artificial Sequence:  Enzymatic Nucleic Acid
ctgtatcaggctagctacaacgataataaat

SEQ ID NO: 16627 - DNA, 31 bp, Artificial Sequence
  Description of Artificial Sequence:  Enzymatic Nucleic Acid
tacctgtaggctagctacaacgacactaata

SEQ ID NO: 16628 - DNA, 31 bp, Artificial Sequence
  Description of Artificial Sequence:  Enzymatic Nucleic Acid
tctacctgggctagctacaacgaatcactaa

SEQ ID NO: 16629 - DNA, 31 bp, Artificial Sequence
  Description of Artificial Sequence:  Enzymatic Nucleic Acid
aaggtctaggctagctacaacgactgtatca

SEQ ID NO: 16630 - DNA, 31 bp, Artificial Sequence
  Description of Artificial Sequence:  Enzymatic Nucleic Acid
acgaaaggggctagctacaacgactacctgt

SEQ ID NO: 16631 - DNA, 31 bp, Artificial Sequence
  Description of Artificial Sequence:  Enzymatic Nucleic Acid
catctctaggctagctacaacgagaaaggtc

SEQ ID NO: 16632 - DNA, 31 bp, Artificial Sequence
  Description of Artificial Sequence:  Enzymatic Nucleic Acid
actgtacaggctagctacaacgactctacga

SEQ ID NO: 16633 - DNA, 31 bp, Artificial Sequence
  Description of Artificial Sequence:  Enzymatic Nucleic Acid
tcactgtaggctagctacaacgaatctctac

SEQ ID NO: 16634 - DNA, 31 bp, Artificial Sequence
  Description of Artificial Sequence:  Enzymatic Nucleic Acid
tttcactgggctagctacaacgaacatctct

SEQ ID NO: 16635 - DNA, 31 bp, Artificial Sequence
  Description of Artificial Sequence:  Enzymatic Nucleic Acid
ggatttcaggctagctacaacgatgtacatc

SEQ ID NO: 16636 - DNA, 31 bp, Artificial Sequence
  Description of Artificial Sequence:  Enzymatic Nucleic Acid
ttcggggaggctagctacaacgattcactgt

SEQ ID NO: 16637 - DNA, 31 bp, Artificial Sequence
  Description of Artificial Sequence:  Enzymatic Nucleic Acid
gtgtataaggctagctacaacgattcgggga

SEQ ID NO: 16638 - DNA, 31 bp, Artificial Sequence
  Description of Artificial Sequence:  Enzymatic Nucleic Acid
catgtgtaggctagctacaacgaaatttcgg

SEQ ID NO: 16639 - DNA, 31 bp, Artificial Sequence
  Description of Artificial Sequence:  Enzymatic Nucleic Acid
gtcatgtgggctagctacaacgaataatttc

SEQ ID NO: 16640 - DNA, 31 bp, Artificial Sequence
  Description of Artificial Sequence:  Enzymatic Nucleic Acid
cagtcatgggctagctacaacgagtataatt

SEQ ID NO: 16641 - DNA, 31 bp, Artificial Sequence
  Description of Artificial Sequence:  Enzymatic Nucleic Acid
ttcagtcaggctagctacaacgagtgtataa

SEQ ID NO: 16642 - DNA, 31 bp, Artificial Sequence
  Description of Artificial Sequence:  Enzymatic Nucleic Acid
tccttcagggctagctacaacgacatgtgta

SEQ ID NO: 16643 - DNA, 31 bp, Artificial Sequence
  Description of Artificial Sequence:  Enzymatic Nucleic Acid
atgacgagggctagctacaacgatcccttcc

SEQ ID NO: 16644 - DNA, 31 bp, Artificial Sequence
  Description of Artificial Sequence:  Enzymatic Nucleic Acid
gggaatgaggctagctacaacgagagctccc

SEQ ID NO: 16645 - DNA, 31 bp, Artificial Sequence
  Description of Artificial Sequence:  Enzymatic Nucleic Acid
gcagggaaggctagctacaacgagacgagct

SEQ ID NO: 16646 - DNA, 31 bp, Artificial Sequence
  Description of Artificial Sequence:  Enzymatic Nucleic Acid
taacccggggctagctacaacgaagggaatg

SEQ ID NO: 16647 - DNA, 31 bp, Artificial Sequence
  Description of Artificial Sequence:  Enzymatic Nucleic Acid
tgacgtaaggctagctacaacgaccggcagg

SEQ ID NO: 16648 - DNA, 31 bp, Artificial Sequence
  Description of Artificial Sequence:  Enzymatic Nucleic Acid
aggtgacgggctagctacaacgaaacccggc

SEQ ID NO: 16649 - DNA, 31 bp, Artificial Sequence
  Description of Artificial Sequence:  Enzymatic Nucleic Acid
ttaggtgaggctagctacaacgagtaacccg

SEQ ID NO: 16650 - DNA, 31 bp, Artificial Sequence
  Description of Artificial Sequence:  Enzymatic Nucleic Acid
atgttaggggctagctacaacgagacgtaac

SEQ ID NO: 16651 - DNA, 31 bp, Artificial Sequence
  Description of Artificial Sequence:  Enzymatic Nucleic Acid
cagtgatgggctagctacaacgataggtgac

SEQ ID NO: 16652 - DNA, 31 bp, Artificial Sequence
  Description of Artificial Sequence:  Enzymatic Nucleic Acid
aacagtgaggctagctacaacgagttaggtg

SEQ ID NO: 16653 - DNA, 31 bp, Artificial Sequence
  Description of Artificial Sequence:  Enzymatic Nucleic Acid
agtaacagggctagctacaacgagatgttag

SEQ ID NO: 16654 - DNA, 31 bp, Artificial Sequence
  Description of Artificial Sequence:  Enzymatic Nucleic Acid
taaagtaaggctagctacaacgaagtgatgt

SEQ ID NO: 16655 - DNA, 31 bp, Artificial Sequence
  Description of Artificial Sequence:  Enzymatic Nucleic Acid
ttttaaagggctagctacaacgaaacagtga

SEQ ID NO: 16656 - DNA, 31 bp, Artificial Sequence
  Description of Artificial Sequence:  Enzymatic Nucleic Acid
agtggaaaggctagctacaacgattttttaa

SEQ ID NO: 16657 - DNA, 31 bp, Artificial Sequence
  Description of Artificial Sequence:  Enzymatic Nucleic Acid
gtgtcaagggctagctacaacgaggaaactt

SEQ ID NO: 16658 - DNA, 31 bp, Artificial Sequence
  Description of Artificial Sequence:  Enzymatic Nucleic Acid
tcaaagtgggctagctacaacgacaagtgga

SEQ ID NO: 16659 - DNA, 31 bp, Artificial Sequence
  Description of Artificial Sequence:  Enzymatic Nucleic Acid
gatcaaagggctagctacaacgagtcaagtg

SEQ ID NO: 16660 - DNA, 31 bp, Artificial Sequence
  Description of Artificial Sequence:  Enzymatic Nucleic Acid
atcagggaggctagctacaacgacaaagtgt

SEQ ID NO: 16661 - DNA, 31 bp, Artificial Sequence
  Description of Artificial Sequence:  Enzymatic Nucleic Acid
gttttccaggctagctacaacgacagggatc

SEQ ID NO: 16662 - DNA, 31 bp, Artificial Sequence
  Description of Artificial Sequence:  Enzymatic Nucleic Acid
attatgcgggctagctacaacgatttccatc

SEQ ID NO: 16663 - DNA, 31 bp, Artificial Sequence
  Description of Artificial Sequence:  Enzymatic Nucleic Acid
agattatgggctagctacaacgagttttcca

SEQ ID NO: 16664 - DNA, 31 bp, Artificial Sequence
  Description of Artificial Sequence:  Enzymatic Nucleic Acid
ccagattaggctagctacaacgagcgttttc

SEQ ID NO: 16665 - DNA, 31 bp, Artificial Sequence
  Description of Artificial Sequence:  Enzymatic Nucleic Acid
gtcccagaggctagctacaacgatatgcgtt

SEQ ID NO: 16666 - DNA, 31 bp, Artificial Sequence
  Description of Artificial Sequence:  Enzymatic Nucleic Acid
ttctactgggctagctacaacgacccagatt

SEQ ID NO: 16667 - DNA, 31 bp, Artificial Sequence
  Description of Artificial Sequence:  Enzymatic Nucleic Acid
cctttctaggctagctacaacgatgtcccag

SEQ ID NO: 16668 - DNA, 31 bp, Artificial Sequence
  Description of Artificial Sequence:  Enzymatic Nucleic Acid
tgatgaagggctagctacaacgacctttcta

SEQ ID NO: 16669 - DNA, 31 bp, Artificial Sequence
  Description of Artificial Sequence:  Enzymatic Nucleic Acid
tgatatgaggctagctacaacgagaagccct

SEQ ID NO: 16670 - DNA, 31 bp, Artificial Sequence
  Description of Artificial Sequence:  Enzymatic Nucleic Acid
atttgataggctagctacaacgagatgaagc

SEQ ID NO: 16671 - DNA, 31 bp, Artificial Sequence
  Description of Artificial Sequence:  Enzymatic Nucleic Acid
gcatttgaggctagctacaacgaatgatgaa

SEQ ID NO: 16672 - DNA, 31 bp, Artificial Sequence
  Description of Artificial Sequence:  Enzymatic Nucleic Acid
acgttgcaggctagctacaacgattgatatg

SEQ ID NO: 16673 - DNA, 31 bp, Artificial Sequence
  Description of Artificial Sequence:  Enzymatic Nucleic Acid
gtacgttgggctagctacaacgaatttgata

SEQ ID NO: 16674 - DNA, 31 bp, Artificial Sequence
  Description of Artificial Sequence:  Enzymatic Nucleic Acid
tttgtacgggctagctacaacgatgcatttg

SEQ ID NO: 16675 - DNA, 31 bp, Artificial Sequence
  Description of Artificial Sequence:  Enzymatic Nucleic Acid
tctttgtaggctagctacaacgagttgcatt

SEQ ID NO: 16676 - DNA, 31 bp, Artificial Sequence
  Description of Artificial Sequence:  Enzymatic Nucleic Acid
tttctttgggctagctacaacgaacgttgca

SEQ ID NO: 16677 - DNA, 31 bp, Artificial Sequence
  Description of Artificial Sequence:  Enzymatic Nucleic Acid
aagccctaggctagctacaacgattctttgt

SEQ ID NO: 16678 - DNA, 31 bp, Artificial Sequence
  Description of Artificial Sequence:  Enzymatic Nucleic Acid
gtcagaagggctagctacaacgacctatttc

SEQ ID NO: 16679 - DNA, 31 bp, Artificial Sequence
  Description of Artificial Sequence:  Enzymatic Nucleic Acid
ttcacaggggctagctacaacgacagaagcc

SEQ ID NO: 16680 - DNA, 31 bp, Artificial Sequence
  Description of Artificial Sequence:  Enzymatic Nucleic Acid
ttgcttcaggctagctacaacgaaggtcaga

SEQ ID NO: 16681 - DNA, 31 bp, Artificial Sequence
  Description of Artificial Sequence:  Enzymatic Nucleic Acid
gactgttgggctagctacaacgattcacagg

SEQ ID NO: 16682 - DNA, 31 bp, Artificial Sequence
  Description of Artificial Sequence:  Enzymatic Nucleic Acid
attgactgggctagctacaacgatgcttcac

SEQ ID NO: 16683 - DNA, 31 bp, Artificial Sequence
  Description of Artificial Sequence:  Enzymatic Nucleic Acid
cccattgaggctagctacaacgatgttgctt

SEQ ID NO: 16684 - DNA, 31 bp, Artificial Sequence
  Description of Artificial Sequence:  Enzymatic Nucleic Acid
aatgcccaggctagctacaacgatgactgtt

SEQ ID NO: 16685 - DNA, 31 bp, Artificial Sequence
  Description of Artificial Sequence:  Enzymatic Nucleic Acid
tacaaatgggctagctacaacgaccattgac

SEQ ID NO: 16686 - DNA, 31 bp, Artificial Sequence
  Description of Artificial Sequence:  Enzymatic Nucleic Acid
tatacaaaggctagctacaacgagcccattg

SEQ ID NO: 16687 - DNA, 31 bp, Artificial Sequence
  Description of Artificial Sequence:  Enzymatic Nucleic Acid
gtcttataggctagctacaacgaaaatgccc

SEQ ID NO: 16688 - DNA, 31 bp, Artificial Sequence
  Description of Artificial Sequence:  Enzymatic Nucleic Acid
ttgtcttaggctagctacaacgaacaaatgc

SEQ ID NO: 16689 - DNA, 31 bp, Artificial Sequence
  Description of Artificial Sequence:  Enzymatic Nucleic Acid
atagtttgggctagctacaacgacttataca

SEQ ID NO: 16690 - DNA, 31 bp, Artificial Sequence
  Description of Artificial Sequence:  Enzymatic Nucleic Acid
tgagatagggctagctacaacgattgtctta

SEQ ID NO: 16691 - DNA, 31 bp, Artificial Sequence
  Description of Artificial Sequence:  Enzymatic Nucleic Acid
gtgtgagaggctagctacaacgaagtttgtc

SEQ ID NO: 16692 - DNA, 31 bp, Artificial Sequence
  Description of Artificial Sequence:  Enzymatic Nucleic Acid
tcgatgtgggctagctacaacgagagatagt

SEQ ID NO: 16693 - DNA, 31 bp, Artificial Sequence
  Description of Artificial Sequence:  Enzymatic Nucleic Acid
tgtcgatgggctagctacaacgagtgagata

SEQ ID NO: 16694 - DNA, 31 bp, Artificial Sequence
  Description of Artificial Sequence:  Enzymatic Nucleic Acid
tttgtcgaggctagctacaacgagtgtgaga

SEQ ID NO: 16695 - DNA, 31 bp, Artificial Sequence
  Description of Artificial Sequence:  Enzymatic Nucleic Acid
ttggtttgggctagctacaacgacgatgtgt

SEQ ID NO: 16696 - DNA, 31 bp, Artificial Sequence
  Description of Artificial Sequence:  Enzymatic Nucleic Acid
tgtattggggctagctacaacgattgtcgat

SEQ ID NO: 16697 - DNA, 31 bp, Artificial Sequence
  Description of Artificial Sequence:  Enzymatic Nucleic Acid
tgattgtaggctagctacaacgatggtttgt

SEQ ID NO: 16698 - DNA, 31 bp, Artificial Sequence
  Description of Artificial Sequence:  Enzymatic Nucleic Acid
tatgattgggctagctacaacgaattggttt

SEQ ID NO: 16699 - DNA, 31 bp, Artificial Sequence
  Description of Artificial Sequence:  Enzymatic Nucleic Acid
atctatgaggctagctacaacgatgtattgg

SEQ ID NO: 16700 - DNA, 31 bp, Artificial Sequence
  Description of Artificial Sequence:  Enzymatic Nucleic Acid
gacatctaggctagctacaacgagattgtat

SEQ ID NO: 16701 - DNA, 31 bp, Artificial Sequence
  Description of Artificial Sequence:  Enzymatic Nucleic Acid
tttggacaggctagctacaacgactatgatt

SEQ ID NO: 16702 - DNA, 31 bp, Artificial Sequence
  Description of Artificial Sequence:  Enzymatic Nucleic Acid
tatttggaggctagctacaacgaatctatga

SEQ ID NO: 16703 - DNA, 31 bp, Artificial Sequence
  Description of Artificial Sequence:  Enzymatic Nucleic Acid
tgtgcttaggctagctacaacgattggacat

SEQ ID NO: 16704 - DNA, 31 bp, Artificial Sequence
  Description of Artificial Sequence:  Enzymatic Nucleic Acid
gtggtgtgggctagctacaacgattatttgg

SEQ ID NO: 16705 - DNA, 31 bp, Artificial Sequence
  Description of Artificial Sequence:  Enzymatic Nucleic Acid
gcgtggtgggctagctacaacgagcttattt

SEQ ID NO: 16706 - DNA, 31 bp, Artificial Sequence
  Description of Artificial Sequence:  Enzymatic Nucleic Acid
gggcgtggggctagctacaacgagtgcttat

SEQ ID NO: 16707 - DNA, 31 bp, Artificial Sequence
  Description of Artificial Sequence:  Enzymatic Nucleic Acid
actgggcgggctagctacaacgaggtgtgct

SEQ ID NO: 16708 - DNA, 31 bp, Artificial Sequence
  Description of Artificial Sequence:  Enzymatic Nucleic Acid
tgactgggggctagctacaacgagtggtgtg

SEQ ID NO: 16709 - DNA, 31 bp, Artificial Sequence
  Description of Artificial Sequence:  Enzymatic Nucleic Acid
taatttgaggctagctacaacgatgggcgtg

SEQ ID NO: 16710 - DNA, 31 bp, Artificial Sequence
  Description of Artificial Sequence:  Enzymatic Nucleic Acid
ctaagtaaggctagctacaacgattgactgg

SEQ ID NO: 16711 - DNA, 31 bp, Artificial Sequence
  Description of Artificial Sequence:  Enzymatic Nucleic Acid
cctctaagggctagctacaacgaaatttgac

SEQ ID NO: 16712 - DNA, 31 bp, Artificial Sequence
  Description of Artificial Sequence:  Enzymatic Nucleic Acid
gagtatggggctagctacaacgactctaagt

SEQ ID NO: 16713 - DNA, 31 bp, Artificial Sequence
  Description of Artificial Sequence:  Enzymatic Nucleic Acid
caagagtaggctagctacaacgaggcctcta

SEQ ID NO: 16714 - DNA, 31 bp, Artificial Sequence
  Description of Artificial Sequence:  Enzymatic Nucleic Acid
gacaagagggctagctacaacgaatggcctc

SEQ ID NO: 16715 - DNA, 31 bp, Artificial Sequence
  Description of Artificial Sequence:  Enzymatic Nucleic Acid
attgaggaggctagctacaacgaaagagtat

SEQ ID NO: 16716 - DNA, 31 bp, Artificial Sequence
  Description of Artificial Sequence:  Enzymatic Nucleic Acid
cagtacaaggctagctacaacgatgaggaca

SEQ ID NO: 16717 - DNA, 31 bp, Artificial Sequence
  Description of Artificial Sequence:  Enzymatic Nucleic Acid
tagcagtaggctagctacaacgaaattgagg

SEQ ID NO: 16718 - DNA, 31 bp, Artificial Sequence
  Description of Artificial Sequence:  Enzymatic Nucleic Acid
ggtagcagggctagctacaacgaacaattga

SEQ ID NO: 16719 - DNA, 31 bp, Artificial Sequence
  Description of Artificial Sequence:  Enzymatic Nucleic Acid
agtggtagggctagctacaacgaagtacaat

SEQ ID NO: 16720 - DNA, 31 bp, Artificial Sequence
  Description of Artificial Sequence:  Enzymatic Nucleic Acid
gggagtggggctagctacaacgaagcagtac

SEQ ID NO: 16721 - DNA, 31 bp, Artificial Sequence
  Description of Artificial Sequence:  Enzymatic Nucleic Acid
caagggagggctagctacaacgaggtagcag

SEQ ID NO: 16722 - DNA, 31 bp, Artificial Sequence
  Description of Artificial Sequence:  Enzymatic Nucleic Acid
ctctcgtgggctagctacaacgatcaaggga

SEQ ID NO: 16723 - DNA, 31 bp, Artificial Sequence
  Description of Artificial Sequence:  Enzymatic Nucleic Acid
aactctcgggctagctacaacgagttcaagg

SEQ ID NO: 16724 - DNA, 31 bp, Artificial Sequence
  Description of Artificial Sequence:  Enzymatic Nucleic Acid
catttgaaggctagctacaacgatctcgtgt

SEQ ID NO: 16725 - DNA, 31 bp, Artificial Sequence
  Description of Artificial Sequence:  Enzymatic Nucleic Acid
ccaggtcaggctagctacaacgattgaactc

SEQ ID NO: 16726 - DNA, 31 bp, Artificial Sequence
  Description of Artificial Sequence:  Enzymatic Nucleic Acid
actccaggggctagctacaacgacatttgaa

SEQ ID NO: 16727 - DNA, 31 bp, Artificial Sequence
  Description of Artificial Sequence:  Enzymatic Nucleic Acid
cagggtaaggctagctacaacgatccaggtc

SEQ ID NO: 16728 - DNA, 31 bp, Artificial Sequence
  Description of Artificial Sequence:  Enzymatic Nucleic Acid
catcagggggctagctacaacgaaactccag

SEQ ID NO: 16729 - DNA, 31 bp, Artificial Sequence
  Description of Artificial Sequence:  Enzymatic Nucleic Acid
ttttttcaggctagctacaacgacagggtaa

SEQ ID NO: 16730 - DNA, 31 bp, Artificial Sequence
  Description of Artificial Sequence:  Enzymatic Nucleic Acid
ctctcttaggctagctacaacgattttttca

SEQ ID NO: 16731 - DNA, 31 bp, Artificial Sequence
  Description of Artificial Sequence:  Enzymatic Nucleic Acid
tacggaagggctagctacaacgatctcttat

SEQ ID NO: 16732 - DNA, 31 bp, Artificial Sequence
  Description of Artificial Sequence:  Enzymatic Nucleic Acid
tcgccttaggctagctacaacgaggaagctc

SEQ ID NO: 16733 - DNA, 31 bp, Artificial Sequence
  Description of Artificial Sequence:  Enzymatic Nucleic Acid
attcgtcgggctagctacaacgacttacgga

SEQ ID NO: 16734 - DNA, 31 bp, Artificial Sequence
  Description of Artificial Sequence:  Enzymatic Nucleic Acid
tcaattcgggctagctacaacgacgccttac

SEQ ID NO: 16735 - DNA, 31 bp, Artificial Sequence
  Description of Artificial Sequence:  Enzymatic Nucleic Acid
ttggtcaaggctagctacaacgatcgtcgcc

SEQ ID NO: 16736 - DNA, 31 bp, Artificial Sequence
  Description of Artificial Sequence:  Enzymatic Nucleic Acid
tgctttggggctagctacaacgacaattcgt

SEQ ID NO: 16737 - DNA, 31 bp, Artificial Sequence
  Description of Artificial Sequence:  Enzymatic Nucleic Acid
gggaattgggctagctacaacgatttggtca

SEQ ID NO: 16738 - DNA, 31 bp, Artificial Sequence
  Description of Artificial Sequence:  Enzymatic Nucleic Acid
catgggaaggctagctacaacgatgctttgg

SEQ ID NO: 16739 - DNA, 31 bp, Artificial Sequence
  Description of Artificial Sequence:  Enzymatic Nucleic Acid
tgttggcaggctagctacaacgagggaattg

SEQ ID NO: 16740 - DNA, 31 bp, Artificial Sequence
  Description of Artificial Sequence:  Enzymatic Nucleic Acid
tatgttggggctagctacaacgaatgggaat

SEQ ID NO: 16741 - DNA, 31 bp, Artificial Sequence
  Description of Artificial Sequence:  Enzymatic Nucleic Acid
agaatatgggctagctacaacgatggcatgg

SEQ ID NO: 16742 - DNA, 31 bp, Artificial Sequence
  Description of Artificial Sequence:  Enzymatic Nucleic Acid
gtagaataggctagctacaacgagttggcat

SEQ ID NO: 16743 - DNA, 31 bp, Artificial Sequence
  Description of Artificial Sequence:  Enzymatic Nucleic Acid
ctgtagaaggctagctacaacgaatgttggc

SEQ ID NO: 16744 - DNA, 31 bp, Artificial Sequence
  Description of Artificial Sequence:  Enzymatic Nucleic Acid
gaacactgggctagctacaacgaagaatatg

SEQ ID NO: 16745 - DNA, 31 bp, Artificial Sequence
  Description of Artificial Sequence:  Enzymatic Nucleic Acid
taagaacaggctagctacaacgatgtagaat

SEQ ID NO: 16746 - DNA, 31 bp, Artificial Sequence
  Description of Artificial Sequence:  Enzymatic Nucleic Acid
agtaagaaggctagctacaacgaactgtaga

SEQ ID NO: 16747 - DNA, 31 bp, Artificial Sequence
  Description of Artificial Sequence:  Enzymatic Nucleic Acid
gtcaatagggctagctacaacgaaagaacac

SEQ ID NO: 16748 - DNA, 31 bp, Artificial Sequence
  Description of Artificial Sequence:  Enzymatic Nucleic Acid
tttgtcaaggctagctacaacgaagtaagaa

SEQ ID NO: 16749 - DNA, 31 bp, Artificial Sequence
  Description of Artificial Sequence:  Enzymatic Nucleic Acid
gcattttgggctagctacaacgacaatagta

SEQ ID NO: 16750 - DNA, 31 bp, Artificial Sequence
  Description of Artificial Sequence:  Enzymatic Nucleic Acid
gttctgcaggctagctacaacgatttgtcaa

SEQ ID NO: 16751 - DNA, 31 bp, Artificial Sequence
  Description of Artificial Sequence:  Enzymatic Nucleic Acid
ttgttctgggctagctacaacgaattttgtc

SEQ ID NO: 16752 - DNA, 31 bp, Artificial Sequence
  Description of Artificial Sequence:  Enzymatic Nucleic Acid
tgtctttgggctagctacaacgatctgcatt

SEQ ID NO: 16753 - DNA, 31 bp, Artificial Sequence
  Description of Artificial Sequence:  Enzymatic Nucleic Acid
gtcctttgggctagctacaacgactttgttc

SEQ ID NO: 16754 - DNA, 31 bp, Artificial Sequence
  Description of Artificial Sequence:  Enzymatic Nucleic Acid
gtataaagggctagctacaacgacctttgtc

SEQ ID NO: 16755 - DNA, 31 bp, Artificial Sequence
  Description of Artificial Sequence:  Enzymatic Nucleic Acid
gacaagtaggctagctacaacgaaaagtcct

SEQ ID NO: 16756 - DNA, 31 bp, Artificial Sequence
  Description of Artificial Sequence:  Enzymatic Nucleic Acid
acgacaagggctagctacaacgaataaagtc

SEQ ID NO: 16757 - DNA, 31 bp, Artificial Sequence
  Description of Artificial Sequence:  Enzymatic Nucleic Acid
ttacacgaggctagctacaacgaaagtataa

SEQ ID NO: 16758 - DNA, 31 bp, Artificial Sequence
  Description of Artificial Sequence:  Enzymatic Nucleic Acid
tccttacaggctagctacaacgagacaagta

SEQ ID NO: 16759 - DNA, 31 bp, Artificial Sequence
  Description of Artificial Sequence:  Enzymatic Nucleic Acid
actccttaggctagctacaacgaacgacaag

SEQ ID NO: 16760 - DNA, 31 bp, Artificial Sequence
  Description of Artificial Sequence:  Enzymatic Nucleic Acid
atggtccaggctagctacaacgatccttaca

SEQ ID NO: 16761 - DNA, 31 bp, Artificial Sequence
  Description of Artificial Sequence:  Enzymatic Nucleic Acid
aatgatggggctagctacaacgaccactcct

SEQ ID NO: 16762 - DNA, 31 bp, Artificial Sequence
  Description of Artificial Sequence:  Enzymatic Nucleic Acid
ttgaatgaggctagctacaacgaggtccact

SEQ ID NO: 16763 - DNA, 31 bp, Artificial Sequence
  Description of Artificial Sequence:  Enzymatic Nucleic Acid
gatttgaaggctagctacaacgagatggtcc

SEQ ID NO: 16764 - DNA, 31 bp, Artificial Sequence
  Description of Artificial Sequence:  Enzymatic Nucleic Acid
ttaacagaggctagctacaacgattgaatga

SEQ ID NO: 16765 - DNA, 31 bp, Artificial Sequence
  Description of Artificial Sequence:  Enzymatic Nucleic Acid
ggtgttaaggctagctacaacgaagatttga

SEQ ID NO: 16766 - DNA, 31 bp, Artificial Sequence
  Description of Artificial Sequence:  Enzymatic Nucleic Acid
ctgaggtgggctagctacaacgataacagat

SEQ ID NO: 16767 - DNA, 31 bp, Artificial Sequence
  Description of Artificial Sequence:  Enzymatic Nucleic Acid
cactgaggggctagctacaacgagttaacag

SEQ ID NO: 16768 - DNA, 31 bp, Artificial Sequence
  Description of Artificial Sequence:  Enzymatic Nucleic Acid
tatatgcaggctagctacaacgatgaggtgt

SEQ ID NO: 16769 - DNA, 31 bp, Artificial Sequence
  Description of Artificial Sequence:  Enzymatic Nucleic Acid
tatatatgggctagctacaacgaactgaggt

SEQ ID NO: 16770 - DNA, 31 bp, Artificial Sequence
  Description of Artificial Sequence:  Enzymatic Nucleic Acid
catatataggctagctacaacgagcactgag

SEQ ID NO: 16771 - DNA, 31 bp, Artificial Sequence
  Description of Artificial Sequence:  Enzymatic Nucleic Acid
atcatataggctagctacaacgaatgcactg

SEQ ID NO: 16772 - DNA, 31 bp, Artificial Sequence
  Description of Artificial Sequence:  Enzymatic Nucleic Acid
ttatcataggctagctacaacgaatatgcac

SEQ ID NO: 16773 - DNA, 31 bp, Artificial Sequence
  Description of Artificial Sequence:  Enzymatic Nucleic Acid
ctttatcaggctagctacaacgaatatatgc

SEQ ID NO: 16774 - DNA, 31 bp, Artificial Sequence
  Description of Artificial Sequence:  Enzymatic Nucleic Acid
atgctttaggctagctacaacgacatatata

SEQ ID NO: 16775 - DNA, 31 bp, Artificial Sequence
  Description of Artificial Sequence:  Enzymatic Nucleic Acid
gatgaatgggctagctacaacgatttatcat

SEQ ID NO: 16776 - DNA, 31 bp, Artificial Sequence
  Description of Artificial Sequence:  Enzymatic Nucleic Acid
gtgatgaaggctagctacaacgagctttatc

SEQ ID NO: 16777 - DNA, 31 bp, Artificial Sequence
  Description of Artificial Sequence:  Enzymatic Nucleic Acid
cacagtgaggctagctacaacgagaatgctt

SEQ ID NO: 16778 - DNA, 31 bp, Artificial Sequence
  Description of Artificial Sequence:  Enzymatic Nucleic Acid
tttcacagggctagctacaacgagatgaatg

SEQ ID NO: 16779 - DNA, 31 bp, Artificial Sequence
  Description of Artificial Sequence:  Enzymatic Nucleic Acid
atgtttcaggctagctacaacgaagtgatga

SEQ ID NO: 16780 - DNA, 31 bp, Artificial Sequence
  Description of Artificial Sequence:  Enzymatic Nucleic Acid
tttcgatgggctagctacaacgattcacagt

SEQ ID NO: 16781 - DNA, 31 bp, Artificial Sequence
  Description of Artificial Sequence:  Enzymatic Nucleic Acid
gttttcgaggctagctacaacgagtttcaca

SEQ ID NO: 16782 - DNA, 31 bp, Artificial Sequence
  Description of Artificial Sequence:  Enzymatic Nucleic Acid
acctgctgggctagctacaacgatttcgatg

SEQ ID NO: 16783 - DNA, 31 bp, Artificial Sequence
  Description of Artificial Sequence:  Enzymatic Nucleic Acid
agcacctgggctagctacaacgatgttttcg

SEQ ID NO: 16784 - DNA, 31 bp, Artificial Sequence
  Description of Artificial Sequence:  Enzymatic Nucleic Acid
ttcaagcaggctagctacaacgactgctgtt

SEQ ID NO: 16785 - DNA, 31 bp, Artificial Sequence
  Description of Artificial Sequence:  Enzymatic Nucleic Acid
gtttcaagggctagctacaacgaacctgctg

SEQ ID NO: 16786 - DNA, 31 bp, Artificial Sequence
  Description of Artificial Sequence:  Enzymatic Nucleic Acid
agctacggggctagctacaacgattcaagca

SEQ ID NO: 16787 - DNA, 31 bp, Artificial Sequence
  Description of Artificial Sequence:  Enzymatic Nucleic Acid
gccagctaggctagctacaacgaggtttcaa

SEQ ID NO: 16788 - DNA, 31 bp, Artificial Sequence
  Description of Artificial Sequence:  Enzymatic Nucleic Acid
cttgccagggctagctacaacgatacggttt

SEQ ID NO: 16789 - DNA, 31 bp, Artificial Sequence
  Description of Artificial Sequence:  Enzymatic Nucleic Acid
accgcttgggctagctacaacgacagctacg

SEQ ID NO: 16790 - DNA, 31 bp, Artificial Sequence
  Description of Artificial Sequence:  Enzymatic Nucleic Acid
taagaccgggctagctacaacgattgccagc

SEQ ID NO: 16791 - DNA, 31 bp, Artificial Sequence
  Description of Artificial Sequence:  Enzymatic Nucleic Acid
cggtaagaggctagctacaacgacgcttgcc

SEQ ID NO: 16792 - DNA, 31 bp, Artificial Sequence
  Description of Artificial Sequence:  Enzymatic Nucleic Acid
agagccggggctagctacaacgaaagaccgc

SEQ ID NO: 16793 - DNA, 31 bp, Artificial Sequence
  Description of Artificial Sequence:  Enzymatic Nucleic Acid
atagagagggctagctacaacgacggtaaga

SEQ ID NO: 16794 - DNA, 31 bp, Artificial Sequence
  Description of Artificial Sequence:  Enzymatic Nucleic Acid
cactttcaggctagctacaacgaagagagcc

SEQ ID NO: 16795 - DNA, 31 bp, Artificial Sequence
  Description of Artificial Sequence:  Enzymatic Nucleic Acid
tgccttcaggctagctacaacgatttcatag

SEQ ID NO: 16796 - DNA, 31 bp, Artificial Sequence
  Description of Artificial Sequence:  Enzymatic Nucleic Acid
gggaaatgggctagctacaacgacttcactt

SEQ ID NO: 16797 - DNA, 31 bp, Artificial Sequence
  Description of Artificial Sequence:  Enzymatic Nucleic Acid
gagggaaaggctagctacaacgagccttcac

SEQ ID NO: 16798 - DNA, 31 bp, Artificial Sequence
  Description of Artificial Sequence:  Enzymatic Nucleic Acid
acttccggggctagctacaacgagagggaaa

SEQ ID NO: 16799 - DNA, 31 bp, Artificial Sequence
  Description of Artificial Sequence:  Enzymatic Nucleic Acid
ccatacaaggctagctacaacgattccggcg

SEQ ID NO: 16800 - DNA, 31 bp, Artificial Sequence
  Description of Artificial Sequence:  Enzymatic Nucleic Acid
taaccataggctagctacaacgaaacttccg

SEQ ID NO: 16801 - DNA, 31 bp, Artificial Sequence
  Description of Artificial Sequence:  Enzymatic Nucleic Acid
tttaaccaggctagctacaacgaacaacttc

SEQ ID NO: 16802 - DNA, 31 bp, Artificial Sequence
  Description of Artificial Sequence:  Enzymatic Nucleic Acid
tcttttaaggctagctacaacgacatacaac

SEQ ID NO: 16803 - DNA, 31 bp, Artificial Sequence
  Description of Artificial Sequence:  Enzymatic Nucleic Acid
gtaacccaggctagctacaacgacttttaac

SEQ ID NO: 16804 - DNA, 31 bp, Artificial Sequence
  Description of Artificial Sequence:  Enzymatic Nucleic Acid
gcaggtaaggctagctacaacgaccatcttt

SEQ ID NO: 16805 - DNA, 31 bp, Artificial Sequence
  Description of Artificial Sequence:  Enzymatic Nucleic Acid
gtcgcaggggctagctacaacgaaacccatc

SEQ ID NO: 16806 - DNA, 31 bp, Artificial Sequence
  Description of Artificial Sequence:  Enzymatic Nucleic Acid
ctcagtcgggctagctacaacgaaggtaacc

SEQ ID NO: 16807 - DNA, 31 bp, Artificial Sequence
  Description of Artificial Sequence:  Enzymatic Nucleic Acid
tttctcagggctagctacaacgacgcaggta

SEQ ID NO: 16808 - DNA, 31 bp, Artificial Sequence
  Description of Artificial Sequence:  Enzymatic Nucleic Acid
cgagcagaggctagctacaacgattctcagt

SEQ ID NO: 16809 - DNA, 31 bp, Artificial Sequence
  Description of Artificial Sequence:  Enzymatic Nucleic Acid
atagcgagggctagctacaacgaagatttct

SEQ ID NO: 16810 - DNA, 31 bp, Artificial Sequence
  Description of Artificial Sequence:  Enzymatic Nucleic Acid
tcaaatagggctagctacaacgagagcagat

SEQ ID NO: 16811 - DNA, 31 bp, Artificial Sequence
  Description of Artificial Sequence:  Enzymatic Nucleic Acid
gagtcaaaggctagctacaacgaagcgagca

SEQ ID NO: 16812 - DNA, 31 bp, Artificial Sequence
  Description of Artificial Sequence:  Enzymatic Nucleic Acid
gccacgagggctagctacaacgacaaatagc

SEQ ID NO: 16813 - DNA, 31 bp, Artificial Sequence
  Description of Artificial Sequence:  Enzymatic Nucleic Acid
agtagccaggctagctacaacgagagtcaaa

SEQ ID NO: 16814 - DNA, 31 bp, Artificial Sequence
  Description of Artificial Sequence:  Enzymatic Nucleic Acid
acgagtagggctagctacaacgacacgagtc

SEQ ID NO: 16815 - DNA, 31 bp, Artificial Sequence
  Description of Artificial Sequence:  Enzymatic Nucleic Acid
ttaacgagggctagctacaacgaagccacga

SEQ ID NO: 16816 - DNA, 31 bp, Artificial Sequence
  Description of Artificial Sequence:  Enzymatic Nucleic Acid
ataattaaggctagctacaacgagagtagcc

SEQ ID NO: 16817 - DNA, 31 bp, Artificial Sequence
  Description of Artificial Sequence:  Enzymatic Nucleic Acid
cttgataaggctagctacaacgataacgagt

SEQ ID NO: 16818 - DNA, 31 bp, Artificial Sequence
  Description of Artificial Sequence:  Enzymatic Nucleic Acid
gtccttgaggctagctacaacgaaattaacg

SEQ ID NO: 16819 - DNA, 31 bp, Artificial Sequence
  Description of Artificial Sequence:  Enzymatic Nucleic Acid
cagttacgggctagctacaacgaccttgata

SEQ ID NO: 16820 - DNA, 31 bp, Artificial Sequence
  Description of Artificial Sequence:  Enzymatic Nucleic Acid
ttcagttaggctagctacaacgagtccttga

SEQ ID NO: 16821 - DNA, 31 bp, Artificial Sequence
  Description of Artificial Sequence:  Enzymatic Nucleic Acid
ctcttcagggctagctacaacgatacgtcct

SEQ ID NO: 16822 - DNA, 31 bp, Artificial Sequence
  Description of Artificial Sequence:  Enzymatic Nucleic Acid
tccctgcaggctagctacaacgacctcttca

SEQ ID NO: 16823 - DNA, 31 bp, Artificial Sequence
  Description of Artificial Sequence:  Enzymatic Nucleic Acid
attccctgggctagctacaacgaatcctctt

SEQ ID NO: 16824 - DNA, 31 bp, Artificial Sequence
  Description of Artificial Sequence:  Enzymatic Nucleic Acid
ttgtataaggctagctacaacgatccctgca

SEQ ID NO: 16825 - DNA, 31 bp, Artificial Sequence
  Description of Artificial Sequence:  Enzymatic Nucleic Acid
agattgtaggctagctacaacgaaattccct

SEQ ID NO: 16826 - DNA, 31 bp, Artificial Sequence
  Description of Artificial Sequence:  Enzymatic Nucleic Acid
caagattgggctagctacaacgaataattcc

SEQ ID NO: 16827 - DNA, 31 bp, Artificial Sequence
  Description of Artificial Sequence:  Enzymatic Nucleic Acid
cagcaagaggctagctacaacgatgtataat

SEQ ID NO: 16828 - DNA, 31 bp, Artificial Sequence
  Description of Artificial Sequence:  Enzymatic Nucleic Acid
atgctcagggctagctacaacgaaagattgt

SEQ ID NO: 16829 - DNA, 31 bp, Artificial Sequence
  Description of Artificial Sequence:  Enzymatic Nucleic Acid
gttttatgggctagctacaacgatcagcaag

SEQ ID NO: 16830 - DNA, 31 bp, Artificial Sequence
  Description of Artificial Sequence:  Enzymatic Nucleic Acid
ctgttttaggctagctacaacgagctcagca

SEQ ID NO: 16831 - DNA, 31 bp, Artificial Sequence
  Description of Artificial Sequence:  Enzymatic Nucleic Acid
tttgactgggctagctacaacgatttatgct

SEQ ID NO: 16832 - DNA, 31 bp, Artificial Sequence
  Description of Artificial Sequence:  Enzymatic Nucleic Acid
acatttgaggctagctacaacgatgttttat

SEQ ID NO: 16833 - DNA, 31 bp, Artificial Sequence
  Description of Artificial Sequence:  Enzymatic Nucleic Acid
taaacacaggctagctacaacgattgactgt

SEQ ID NO: 16834 - DNA, 31 bp, Artificial Sequence
  Description of Artificial Sequence:  Enzymatic Nucleic Acid
tttaaacaggctagctacaacgaatttgact

SEQ ID NO: 16835 - DNA, 31 bp, Artificial Sequence
  Description of Artificial Sequence:  Enzymatic Nucleic Acid
tttttaaaggctagctacaacgaacatttga

SEQ ID NO: 16836 - DNA, 31 bp, Artificial Sequence
  Description of Artificial Sequence:  Enzymatic Nucleic Acid
cagtgaggggctagctacaacgattttaaac

SEQ ID NO: 16837 - DNA, 31 bp, Artificial Sequence
  Description of Artificial Sequence:  Enzymatic Nucleic Acid
agtggcagggctagctacaacgagaggtttt

SEQ ID NO: 16838 - DNA, 31 bp, Artificial Sequence
  Description of Artificial Sequence:  Enzymatic Nucleic Acid
tagagtggggctagctacaacgaagtgaggt

SEQ ID NO: 16839 - DNA, 31 bp, Artificial Sequence
  Description of Artificial Sequence:  Enzymatic Nucleic Acid
aattagagggctagctacaacgaggcagtga

SEQ ID NO: 16840 - DNA, 31 bp, Artificial Sequence
  Description of Artificial Sequence:  Enzymatic Nucleic Acid
attgacaaggctagctacaacgatagagtgg

SEQ ID NO: 16841 - DNA, 31 bp, Artificial Sequence
  Description of Artificial Sequence:  Enzymatic Nucleic Acid
cacattgaggctagctacaacgaaattagag

SEQ ID NO: 16842 - DNA, 31 bp, Artificial Sequence
  Description of Artificial Sequence:  Enzymatic Nucleic Acid
gtttcacaggctagctacaacgatgacaatt

SEQ ID NO: 16843 - DNA, 31 bp, Artificial Sequence
  Description of Artificial Sequence:  Enzymatic Nucleic Acid
gggtttcaggctagctacaacgaattgacaa

SEQ ID NO: 16844 - DNA, 31 bp, Artificial Sequence
  Description of Artificial Sequence:  Enzymatic Nucleic Acid
atctggggggctagctacaacgattcacatt

SEQ ID NO: 16845 - DNA, 31 bp, Artificial Sequence
  Description of Artificial Sequence:  Enzymatic Nucleic Acid
ttcgtaaaggctagctacaacgactggggtt

SEQ ID NO: 16846 - DNA, 31 bp, Artificial Sequence
  Description of Artificial Sequence:  Enzymatic Nucleic Acid
ccttttcgggctagctacaacgaaaatctgg

SEQ ID NO: 16847 - DNA, 31 bp, Artificial Sequence
  Description of Artificial Sequence:  Enzymatic Nucleic Acid
tgacacggggctagctacaacgacttttcgt

SEQ ID NO: 16848 - DNA, 31 bp, Artificial Sequence
  Description of Artificial Sequence:  Enzymatic Nucleic Acid
cgatgacaggctagctacaacgaggcctttt

SEQ ID NO: 16849 - DNA, 31 bp, Artificial Sequence
  Description of Artificial Sequence:  Enzymatic Nucleic Acid
aacgatgaggctagctacaacgaacggcctt

SEQ ID NO: 16850 - DNA, 31 bp, Artificial Sequence
  Description of Artificial Sequence:  Enzymatic Nucleic Acid
ggaaacgaggctagctacaacgagacacggc

SEQ ID NO: 16851 - DNA, 31 bp, Artificial Sequence
  Description of Artificial Sequence:  Enzymatic Nucleic Acid
tctggaaaggctagctacaacgagatgacac

SEQ ID NO: 16852 - DNA, 31 bp, Artificial Sequence
  Description of Artificial Sequence:  Enzymatic Nucleic Acid
gagccgggggctagctacaacgactggaaac

SEQ ID NO: 16853 - DNA, 31 bp, Artificial Sequence
  Description of Artificial Sequence:  Enzymatic Nucleic Acid
gtagagagggctagctacaacgacgggtctg

SEQ ID NO: 16854 - DNA, 31 bp, Artificial Sequence
  Description of Artificial Sequence:  Enzymatic Nucleic Acid
ccagtgggggctagctacaacgaagagagcc

SEQ ID NO: 16855 - DNA, 31 bp, Artificial Sequence
  Description of Artificial Sequence:  Enzymatic Nucleic Acid
ctgcccagggctagctacaacgagggtagag

SEQ ID NO: 16856 - DNA, 31 bp, Artificial Sequence
  Description of Artificial Sequence:  Enzymatic Nucleic Acid
gtctgctgggctagctacaacgaccagtggg

SEQ ID NO: 16857 - DNA, 31 bp, Artificial Sequence
  Description of Artificial Sequence:  Enzymatic Nucleic Acid
tttgtctgggctagctacaacgatgcccagt

SEQ ID NO: 16858 - DNA, 31 bp, Artificial Sequence
  Description of Artificial Sequence:  Enzymatic Nucleic Acid
aggatttgggctagctacaacgactgctgcc

SEQ ID NO: 16859 - DNA, 31 bp, Artificial Sequence
  Description of Artificial Sequence:  Enzymatic Nucleic Acid
agtcaggaggctagctacaacgattgtctgc

SEQ ID NO: 16860 - DNA, 31 bp, Artificial Sequence
  Description of Artificial Sequence:  Enzymatic Nucleic Acid
ggtacaagggctagctacaacgacaggattt

SEQ ID NO: 16861 - DNA, 31 bp, Artificial Sequence
  Description of Artificial Sequence:  Enzymatic Nucleic Acid
atgcggtaggctagctacaacgaaagtcagg

SEQ ID NO: 16862 - DNA, 31 bp, Artificial Sequence
  Description of Artificial Sequence:  Enzymatic Nucleic Acid
atatgcggggctagctacaacgaacaagtca

SEQ ID NO: 16863 - DNA, 31 bp, Artificial Sequence
  Description of Artificial Sequence:  Enzymatic Nucleic Acid
accatatgggctagctacaacgaggtacaag

SEQ ID NO: 16864 - DNA, 31 bp, Artificial Sequence
  Description of Artificial Sequence:  Enzymatic Nucleic Acid
ataccataggctagctacaacgagcggtaca

SEQ ID NO: 16865 - DNA, 31 bp, Artificial Sequence
  Description of Artificial Sequence:  Enzymatic Nucleic Acid
ggataccaggctagctacaacgaatgcggta

SEQ ID NO: 16866 - DNA, 31 bp, Artificial Sequence
  Description of Artificial Sequence:  Enzymatic Nucleic Acid
gagggataggctagctacaacgacatatgcg

SEQ ID NO: 16867 - DNA, 31 bp, Artificial Sequence
  Description of Artificial Sequence:  Enzymatic Nucleic Acid
ttgagggaggctagctacaacgaaccatatg

SEQ ID NO: 16868 - DNA, 31 bp, Artificial Sequence
  Description of Artificial Sequence:  Enzymatic Nucleic Acid
attgtaggggctagctacaacgatgagggat

SEQ ID NO: 16869 - DNA, 31 bp, Artificial Sequence
  Description of Artificial Sequence:  Enzymatic Nucleic Acid
cttgattgggctagctacaacgaaggttgag

SEQ ID NO: 16870 - DNA, 31 bp, Artificial Sequence
  Description of Artificial Sequence:  Enzymatic Nucleic Acid
ccacttgaggctagctacaacgatgtaggtt

SEQ ID NO: 16871 - DNA, 31 bp, Artificial Sequence
  Description of Artificial Sequence:  Enzymatic Nucleic Acid
cagaaccaggctagctacaacgattgattgt

SEQ ID NO: 16872 - DNA, 31 bp, Artificial Sequence
  Description of Artificial Sequence:  Enzymatic Nucleic Acid
tgccagaaggctagctacaacgacacttgat

SEQ ID NO: 16873 - DNA, 31 bp, Artificial Sequence
  Description of Artificial Sequence:  Enzymatic Nucleic Acid
caggggtgggctagctacaacgacagaacca

SEQ ID NO: 16874 - DNA, 31 bp, Artificial Sequence
  Description of Artificial Sequence:  Enzymatic Nucleic Acid
tacaggggggctagctacaacgagccagaac

SEQ ID NO: 16875 - DNA, 31 bp, Artificial Sequence
  Description of Artificial Sequence:  Enzymatic Nucleic Acid
tatggttaggctagctacaacgaaggggtgc

SEQ ID NO: 16876 - DNA, 31 bp, Artificial Sequence
  Description of Artificial Sequence:  Enzymatic Nucleic Acid
gattatggggctagctacaacgatacagggg

SEQ ID NO: 16877 - DNA, 31 bp, Artificial Sequence
  Description of Artificial Sequence:  Enzymatic Nucleic Acid
aatgattaggctagctacaacgaggttacag

SEQ ID NO: 16878 - DNA, 31 bp, Artificial Sequence
  Description of Artificial Sequence:  Enzymatic Nucleic Acid
cggaatgaggctagctacaacgatatggtta

SEQ ID NO: 16879 - DNA, 31 bp, Artificial Sequence
  Description of Artificial Sequence:  Enzymatic Nucleic Acid
cttcggaaggctagctacaacgagattatgg

SEQ ID NO: 16880 - DNA, 31 bp, Artificial Sequence
  Description of Artificial Sequence:  Enzymatic Nucleic Acid
acaccttgggctagctacaacgattcggaat

SEQ ID NO: 16881 - DNA, 31 bp, Artificial Sequence
  Description of Artificial Sequence:  Enzymatic Nucleic Acid
aagtcacaggctagctacaacgacttgcttc

SEQ ID NO: 16882 - DNA, 31 bp, Artificial Sequence
  Description of Artificial Sequence:  Enzymatic Nucleic Acid
aaaagtcaggctagctacaacgaaccttgct

SEQ ID NO: 16883 - DNA, 31 bp, Artificial Sequence
  Description of Artificial Sequence:  Enzymatic Nucleic Acid
aacaaaagggctagctacaacgacacacctt

SEQ ID NO: 16884 - DNA, 31 bp, Artificial Sequence
  Description of Artificial Sequence:  Enzymatic Nucleic Acid
tattggaaggctagctacaacgaaaaagtca

SEQ ID NO: 16885 - DNA, 31 bp, Artificial Sequence
  Description of Artificial Sequence:  Enzymatic Nucleic Acid
cttcattaggctagctacaacgatggaacaa

SEQ ID NO: 16886 - DNA, 31 bp, Artificial Sequence
  Description of Artificial Sequence:  Enzymatic Nucleic Acid
actcttcaggctagctacaacgatattggaa

SEQ ID NO: 16887 - DNA, 31 bp, Artificial Sequence
  Description of Artificial Sequence:  Enzymatic Nucleic Acid
ataaaggaggctagctacaacgatcttcatt

SEQ ID NO: 16888 - DNA, 31 bp, Artificial Sequence
  Description of Artificial Sequence:  Enzymatic Nucleic Acid
atccaggaggctagctacaacgaaaaggact

SEQ ID NO: 16889 - DNA, 31 bp, Artificial Sequence
  Description of Artificial Sequence:  Enzymatic Nucleic Acid
tgtcagcaggctagctacaacgaccaggata

SEQ ID NO: 16890 - DNA, 31 bp, Artificial Sequence
  Description of Artificial Sequence:  Enzymatic Nucleic Acid
gctgtcagggctagctacaacgaatccagga

SEQ ID NO: 16891 - DNA, 31 bp, Artificial Sequence
  Description of Artificial Sequence:  Enzymatic Nucleic Acid
tgttgctgggctagctacaacgacagcatcc

SEQ ID NO: 16892 - DNA, 31 bp, Artificial Sequence
  Description of Artificial Sequence:  Enzymatic Nucleic Acid
ccatgttgggctagctacaacgatgtcagca

SEQ ID NO: 16893 - DNA, 31 bp, Artificial Sequence
  Description of Artificial Sequence:  Enzymatic Nucleic Acid
ttcccatgggctagctacaacgatgctgtca

SEQ ID NO: 16894 - DNA, 31 bp, Artificial Sequence
  Description of Artificial Sequence:  Enzymatic Nucleic Acid
gtttcccaggctagctacaacgagttgctgt

SEQ ID NO: 16895 - DNA, 31 bp, Artificial Sequence
  Description of Artificial Sequence:  Enzymatic Nucleic Acid
caattctgggctagctacaacgattcccatg

SEQ ID NO: 16896 - DNA, 31 bp, Artificial Sequence
  Description of Artificial Sequence:  Enzymatic Nucleic Acid
gctctcaaggctagctacaacgatctgtttc

SEQ ID NO: 16897 - DNA, 31 bp, Artificial Sequence
  Description of Artificial Sequence:  Enzymatic Nucleic Acid
gagtgatgggctagctacaacgatctcaatt

SEQ ID NO: 16898 - DNA, 31 bp, Artificial Sequence
  Description of Artificial Sequence:  Enzymatic Nucleic Acid
ctgagtgaggctagctacaacgagctctcaa

SEQ ID NO: 16899 - DNA, 31 bp, Artificial Sequence
  Description of Artificial Sequence:  Enzymatic Nucleic Acid
gcgctgagggctagctacaacgagatgctct

SEQ ID NO: 16900 - DNA, 31 bp, Artificial Sequence
  Description of Artificial Sequence:  Enzymatic Nucleic Acid
gccatgcgggctagctacaacgatgagtgat

SEQ ID NO: 16901 - DNA, 31 bp, Artificial Sequence
  Description of Artificial Sequence:  Enzymatic Nucleic Acid
ttgccatgggctagctacaacgagctgagtg

SEQ ID NO: 16902 - DNA, 31 bp, Artificial Sequence
  Description of Artificial Sequence:  Enzymatic Nucleic Acid
tattgccaggctagctacaacgagcgctgag

SEQ ID NO: 16903 - DNA, 31 bp, Artificial Sequence
  Description of Artificial Sequence:  Enzymatic Nucleic Acid
tattattgggctagctacaacgacatgcgct

SEQ ID NO: 16904 - DNA, 31 bp, Artificial Sequence
  Description of Artificial Sequence:  Enzymatic Nucleic Acid
ttctattaggctagctacaacgatgccatgc

SEQ ID NO: 16905 - DNA, 31 bp, Artificial Sequence
  Description of Artificial Sequence:  Enzymatic Nucleic Acid
tccttctaggctagctacaacgatattgcca

SEQ ID NO: 16906 - DNA, 31 bp, Artificial Sequence
  Description of Artificial Sequence:  Enzymatic Nucleic Acid
ccatcttaggctagctacaacgatctttcct

SEQ ID NO: 16907 - DNA, 31 bp, Artificial Sequence
  Description of Artificial Sequence:  Enzymatic Nucleic Acid
gctagccaggctagctacaacgacttattct

SEQ ID NO: 16908 - DNA, 31 bp, Artificial Sequence
  Description of Artificial Sequence:  Enzymatic Nucleic Acid
ggtgctagggctagctacaacgacatcttat

SEQ ID NO: 16909 - DNA, 31 bp, Artificial Sequence
  Description of Artificial Sequence:  Enzymatic Nucleic Acid
ccaaggtgggctagctacaacgatagccatc

SEQ ID NO: 16910 - DNA, 31 bp, Artificial Sequence
  Description of Artificial Sequence:  Enzymatic Nucleic Acid
aaccaaggggctagctacaacgagctagcca

SEQ ID NO: 16911 - DNA, 31 bp, Artificial Sequence
  Description of Artificial Sequence:  Enzymatic Nucleic Acid
agccacaaggctagctacaacgacaaggtgc

SEQ ID NO: 16912 - DNA, 31 bp, Artificial Sequence
  Description of Artificial Sequence:  Enzymatic Nucleic Acid
gtcagccaggctagctacaacgaaaccaagg

SEQ ID NO: 16913 - DNA, 31 bp, Artificial Sequence
  Description of Artificial Sequence:  Enzymatic Nucleic Acid
agagtcagggctagctacaacgacacaacca

SEQ ID NO: 16914 - DNA, 31 bp, Artificial Sequence
  Description of Artificial Sequence:  Enzymatic Nucleic Acid
ttctagagggctagctacaacgacagccaca

SEQ ID NO: 16915 - DNA, 31 bp, Artificial Sequence
  Description of Artificial Sequence:  Enzymatic Nucleic Acid
tccagaaaggctagctacaacgatctagagt

SEQ ID NO: 16916 - DNA, 31 bp, Artificial Sequence
  Description of Artificial Sequence:  Enzymatic Nucleic Acid
aatgtagaggctagctacaacgatccagaaa

SEQ ID NO: 16917 - DNA, 31 bp, Artificial Sequence
  Description of Artificial Sequence:  Enzymatic Nucleic Acid
tgcaaatgggctagctacaacgaagattcca

SEQ ID NO: 16918 - DNA, 31 bp, Artificial Sequence
  Description of Artificial Sequence:  Enzymatic Nucleic Acid
tatgcaaaggctagctacaacgagtagattc

SEQ ID NO: 16919 - DNA, 31 bp, Artificial Sequence
  Description of Artificial Sequence:  Enzymatic Nucleic Acid
aagctatgggctagctacaacgaaaatgtag

SEQ ID NO: 16920 - DNA, 31 bp, Artificial Sequence
  Description of Artificial Sequence:  Enzymatic Nucleic Acid
ggaagctaggctagctacaacgagcaaatgt

SEQ ID NO: 16921 - DNA, 31 bp, Artificial Sequence
  Description of Artificial Sequence:  Enzymatic Nucleic Acid
attggaagggctagctacaacgatatgcaaa

SEQ ID NO: 16922 - DNA, 31 bp, Artificial Sequence
  Description of Artificial Sequence:  Enzymatic Nucleic Acid
caactttaggctagctacaacgatggaagct

SEQ ID NO: 16923 - DNA, 31 bp, Artificial Sequence
  Description of Artificial Sequence:  Enzymatic Nucleic Acid
agtcccaaggctagctacaacgatttattgg

SEQ ID NO: 16924 - DNA, 31 bp, Artificial Sequence
  Description of Artificial Sequence:  Enzymatic Nucleic Acid
tcccacagggctagctacaacgacccaactt

SEQ ID NO: 16925 - DNA, 31 bp, Artificial Sequence
  Description of Artificial Sequence:  Enzymatic Nucleic Acid
tcttcccaggctagctacaacgaagtcccaa

SEQ ID NO: 16926 - DNA, 31 bp, Artificial Sequence
  Description of Artificial Sequence:  Enzymatic Nucleic Acid
agcttatgggctagctacaacgattcttccc

SEQ ID NO: 16927 - DNA, 31 bp, Artificial Sequence
  Description of Artificial Sequence:  Enzymatic Nucleic Acid
aaagcttaggctagctacaacgagtttcttc

SEQ ID NO: 16928 - DNA, 31 bp, Artificial Sequence
  Description of Artificial Sequence:  Enzymatic Nucleic Acid
tataaaagggctagctacaacgattatgttt

SEQ ID NO: 16929 - DNA, 31 bp, Artificial Sequence
  Description of Artificial Sequence:  Enzymatic Nucleic Acid
ctgtgataggctagctacaacgaaaaagctt

SEQ ID NO: 16930 - DNA, 31 bp, Artificial Sequence
  Description of Artificial Sequence:  Enzymatic Nucleic Acid
atctgtgaggctagctacaacgaataaaagc

SEQ ID NO: 16931 - DNA, 31 bp, Artificial Sequence
  Description of Artificial Sequence:  Enzymatic Nucleic Acid
cacatctgggctagctacaacgagatataaa

SEQ ID NO: 16932 - DNA, 31 bp, Artificial Sequence
  Description of Artificial Sequence:  Enzymatic Nucleic Acid
ttggcacaggctagctacaacgactgtgata

SEQ ID NO: 16933 - DNA, 31 bp, Artificial Sequence
  Description of Artificial Sequence:  Enzymatic Nucleic Acid
atttggcaggctagctacaacgaatctgtga

SEQ ID NO: 16934 - DNA, 31 bp, Artificial Sequence
  Description of Artificial Sequence:  Enzymatic Nucleic Acid
ccatttggggctagctacaacgaacatctgt

SEQ ID NO: 16935 - DNA, 31 bp, Artificial Sequence
  Description of Artificial Sequence:  Enzymatic Nucleic Acid
gaaacccaggctagctacaacgattggcaca

SEQ ID NO: 16936 - DNA, 31 bp, Artificial Sequence
  Description of Artificial Sequence:  Enzymatic Nucleic Acid
acatgaaaggctagctacaacgaccatttgg

SEQ ID NO: 16937 - DNA, 31 bp, Artificial Sequence
  Description of Artificial Sequence:  Enzymatic Nucleic Acid
agttaacaggctagctacaacgagaaaccca

SEQ ID NO: 16938 - DNA, 31 bp, Artificial Sequence
  Description of Artificial Sequence:  Enzymatic Nucleic Acid
caagttaaggctagctacaacgaatgaaacc

SEQ ID NO: 16939 - DNA, 31 bp, Artificial Sequence
  Description of Artificial Sequence:  Enzymatic Nucleic Acid
tttccaagggctagctacaacgataacatga

SEQ ID NO: 16940 - DNA, 31 bp, Artificial Sequence
  Description of Artificial Sequence:  Enzymatic Nucleic Acid
cgtcggcaggctagctacaacgatttttcca

SEQ ID NO: 16941 - DNA, 31 bp, Artificial Sequence
  Description of Artificial Sequence:  Enzymatic Nucleic Acid
tccgtcggggctagctacaacgaattttttc

SEQ ID NO: 16942 - DNA, 31 bp, Artificial Sequence
  Description of Artificial Sequence:  Enzymatic Nucleic Acid
tccttccgggctagctacaacgacggcattt

SEQ ID NO: 16943 - DNA, 31 bp, Artificial Sequence
  Description of Artificial Sequence:  Enzymatic Nucleic Acid
gtttcaggggctagctacaacgacctctcct

SEQ ID NO: 16944 - DNA, 31 bp, Artificial Sequence
  Description of Artificial Sequence:  Enzymatic Nucleic Acid
caagacagggctagctacaacgattcaggtc

SEQ ID NO: 16945 - DNA, 31 bp, Artificial Sequence
  Description of Artificial Sequence:  Enzymatic Nucleic Acid
gtgcaagaggctagctacaacgaagtttcag

SEQ ID NO: 16946 - DNA, 31 bp, Artificial Sequence
  Description of Artificial Sequence:  Enzymatic Nucleic Acid
taactgtgggctagctacaacgaaagacagt

SEQ ID NO: 16947 - DNA, 31 bp, Artificial Sequence
  Description of Artificial Sequence:  Enzymatic Nucleic Acid
gttaactgggctagctacaacgagcaagaca

SEQ ID NO: 16948 - DNA, 31 bp, Artificial Sequence
  Description of Artificial Sequence:  Enzymatic Nucleic Acid
cttgttaaggctagctacaacgatgtgcaag

SEQ ID NO: 16949 - DNA, 31 bp, Artificial Sequence
  Description of Artificial Sequence:  Enzymatic Nucleic Acid
agaacttgggctagctacaacgataactgtg

SEQ ID NO: 16950 - DNA, 31 bp, Artificial Sequence
  Description of Artificial Sequence:  Enzymatic Nucleic Acid
tataagaaggctagctacaacgattgttaac

SEQ ID NO: 16951 - DNA, 31 bp, Artificial Sequence
  Description of Artificial Sequence:  Enzymatic Nucleic Acid
tctctgtaggctagctacaacgaaagaactt

SEQ ID NO: 16952 - DNA, 31 bp, Artificial Sequence
  Description of Artificial Sequence:  Enzymatic Nucleic Acid
cgtctctgggctagctacaacgaataagaac

SEQ ID NO: 16953 - DNA, 31 bp, Artificial Sequence
  Description of Artificial Sequence:  Enzymatic Nucleic Acid
aagtaacgggctagctacaacgactctgtat

SEQ ID NO: 16954 - DNA, 31 bp, Artificial Sequence
  Description of Artificial Sequence:  Enzymatic Nucleic Acid
ccaagtaaggctagctacaacgagtctctgt

SEQ ID NO: 16955 - DNA, 31 bp, Artificial Sequence
  Description of Artificial Sequence:  Enzymatic Nucleic Acid
aatccaagggctagctacaacgaaacgtctc

SEQ ID NO: 16956 - DNA, 31 bp, Artificial Sequence
  Description of Artificial Sequence:  Enzymatic Nucleic Acid
cagtaaaaggctagctacaacgaccaagtaa

SEQ ID NO: 16957 - DNA, 31 bp, Artificial Sequence
  Description of Artificial Sequence:  Enzymatic Nucleic Acid
gtccgcagggctagctacaacgaaaaatcca

SEQ ID NO: 16958 - DNA, 31 bp, Artificial Sequence
  Description of Artificial Sequence:  Enzymatic Nucleic Acid
actgtccgggctagctacaacgaagtaaaat

SEQ ID NO: 16959 - DNA, 31 bp, Artificial Sequence
  Description of Artificial Sequence:  Enzymatic Nucleic Acid
attaactgggctagctacaacgaccgcagta

SEQ ID NO: 16960 - DNA, 31 bp, Artificial Sequence
  Description of Artificial Sequence:  Enzymatic Nucleic Acid
gttattaaggctagctacaacgatgtccgca

SEQ ID NO: 16961 - DNA, 31 bp, Artificial Sequence
  Description of Artificial Sequence:  Enzymatic Nucleic Acid
ttctgttaggctagctacaacgataactgtc

SEQ ID NO: 16962 - DNA, 31 bp, Artificial Sequence
  Description of Artificial Sequence:  Enzymatic Nucleic Acid
ttgttctgggctagctacaacgatattaact

SEQ ID NO: 16963 - DNA, 31 bp, Artificial Sequence
  Description of Artificial Sequence:  Enzymatic Nucleic Acid
gtgcattgggctagctacaacgatctgttat

SEQ ID NO: 16964 - DNA, 31 bp, Artificial Sequence
  Description of Artificial Sequence:  Enzymatic Nucleic Acid
gtagtgcaggctagctacaacgatgttctgt

SEQ ID NO: 16965 - DNA, 31 bp, Artificial Sequence
  Description of Artificial Sequence:  Enzymatic Nucleic Acid
ctgtagtgggctagctacaacgaattgttct

SEQ ID NO: 16966 - DNA, 31 bp, Artificial Sequence
  Description of Artificial Sequence:  Enzymatic Nucleic Acid
tactgtagggctagctacaacgagcattgtt

SEQ ID NO: 16967 - DNA, 31 bp, Artificial Sequence
  Description of Artificial Sequence:  Enzymatic Nucleic Acid
taatactgggctagctacaacgaagtgcatt

SEQ ID NO: 16968 - DNA, 31 bp, Artificial Sequence
  Description of Artificial Sequence:  Enzymatic Nucleic Acid
tgctaataggctagctacaacgatgtagtgc

SEQ ID NO: 16969 - DNA, 31 bp, Artificial Sequence
  Description of Artificial Sequence:  Enzymatic Nucleic Acid
cttgctaaggctagctacaacgaactgtagt

SEQ ID NO: 16970 - DNA, 31 bp, Artificial Sequence
  Description of Artificial Sequence:  Enzymatic Nucleic Acid
tttgcttgggctagctacaacgataatactg

SEQ ID NO: 16971 - DNA, 31 bp, Artificial Sequence
  Description of Artificial Sequence:  Enzymatic Nucleic Acid
attttttgggctagctacaacgattgctaat

SEQ ID NO: 16972 - DNA, 31 bp, Artificial Sequence
  Description of Artificial Sequence:  Enzymatic Nucleic Acid
gatggccaggctagctacaacgatttttgct

SEQ ID NO: 16973 - DNA, 31 bp, Artificial Sequence
  Description of Artificial Sequence:  Enzymatic Nucleic Acid
agtgatggggctagctacaacgacatttttt

SEQ ID NO: 16974 - DNA, 31 bp, Artificial Sequence
  Description of Artificial Sequence:  Enzymatic Nucleic Acid
cttagtgaggctagctacaacgaggccattt

SEQ ID NO: 16975 - DNA, 31 bp, Artificial Sequence
  Description of Artificial Sequence:  Enzymatic Nucleic Acid
ctccttagggctagctacaacgagatggcca

SEQ ID NO: 16976 - DNA, 31 bp, Artificial Sequence
  Description of Artificial Sequence:  Enzymatic Nucleic Acid
atggagtgggctagctacaacgatccttagt

SEQ ID NO: 16977 - DNA, 31 bp, Artificial Sequence
  Description of Artificial Sequence:  Enzymatic Nucleic Acid
tgatggagggctagctacaacgagctcctta

SEQ ID NO: 16978 - DNA, 31 bp, Artificial Sequence
  Description of Artificial Sequence:  Enzymatic Nucleic Acid
aagagtgaggctagctacaacgaggagtgct

SEQ ID NO: 16979 - DNA, 31 bp, Artificial Sequence
  Description of Artificial Sequence:  Enzymatic Nucleic Acid
attaagagggctagctacaacgagatggagt

SEQ ID NO: 16980 - DNA, 31 bp, Artificial Sequence
  Description of Artificial Sequence:  Enzymatic Nucleic Acid
tggtaagaggctagctacaacgataagagtg

SEQ ID NO: 16981 - DNA, 31 bp, Artificial Sequence
  Description of Artificial Sequence:  Enzymatic Nucleic Acid
catgatggggctagctacaacgaaagattaa

SEQ ID NO: 16982 - DNA, 31 bp, Artificial Sequence
  Description of Artificial Sequence:  Enzymatic Nucleic Acid
attcatgaggctagctacaacgaggtaagat

SEQ ID NO: 16983 - DNA, 31 bp, Artificial Sequence
  Description of Artificial Sequence:  Enzymatic Nucleic Acid
aacattcaggctagctacaacgagatggtaa

SEQ ID NO: 16984 - DNA, 31 bp, Artificial Sequence
  Description of Artificial Sequence:  Enzymatic Nucleic Acid
gggaaacaggctagctacaacgatcatgatg

SEQ ID NO: 16985 - DNA, 31 bp, Artificial Sequence
  Description of Artificial Sequence:  Enzymatic Nucleic Acid
cagggaaaggctagctacaacgaattcatga

SEQ ID NO: 16986 - DNA, 31 bp, Artificial Sequence
  Description of Artificial Sequence:  Enzymatic Nucleic Acid
gaatcttgggctagctacaacgaagggaaac

SEQ ID NO: 16987 - DNA, 31 bp, Artificial Sequence
  Description of Artificial Sequence:  Enzymatic Nucleic Acid
tgcctgaaggctagctacaacgacttgcagg

SEQ ID NO: 16988 - DNA, 31 bp, Artificial Sequence
  Description of Artificial Sequence:  Enzymatic Nucleic Acid
cataggtgggctagctacaacgactgaatct

SEQ ID NO: 16989 - DNA, 31 bp, Artificial Sequence
  Description of Artificial Sequence:  Enzymatic Nucleic Acid
ggcataggggctagctacaacgagcctgaat

SEQ ID NO: 16990 - DNA, 31 bp, Artificial Sequence
  Description of Artificial Sequence:  Enzymatic Nucleic Acid
tgcaggcaggctagctacaacgaaggtgcct

SEQ ID NO: 16991 - DNA, 31 bp, Artificial Sequence
  Description of Artificial Sequence:  Enzymatic Nucleic Acid
tctgcaggggctagctacaacgaataggtgc

SEQ ID NO: 16992 - DNA, 31 bp, Artificial Sequence
  Description of Artificial Sequence:  Enzymatic Nucleic Acid
tggctctgggctagctacaacgaaggcatag

SEQ ID NO: 16993 - DNA, 31 bp, Artificial Sequence
  Description of Artificial Sequence:  Enzymatic Nucleic Acid
attcctggggctagctacaacgatctgcagg

SEQ ID NO: 16994 - DNA, 31 bp, Artificial Sequence
  Description of Artificial Sequence:  Enzymatic Nucleic Acid
tgtatacaggctagctacaacgatcctggct

SEQ ID NO: 16995 - DNA, 31 bp, Artificial Sequence
  Description of Artificial Sequence:  Enzymatic Nucleic Acid
tgtgtataggctagctacaacgaattcctgg

SEQ ID NO: 16996 - DNA, 31 bp, Artificial Sequence
  Description of Artificial Sequence:  Enzymatic Nucleic Acid
cctgtgtaggctagctacaacgaacattcct

SEQ ID NO: 16997 - DNA, 31 bp, Artificial Sequence
  Description of Artificial Sequence:  Enzymatic Nucleic Acid
cccctgtgggctagctacaacgaatacattc

SEQ ID NO: 16998 - DNA, 31 bp, Artificial Sequence
  Description of Artificial Sequence:  Enzymatic Nucleic Acid
ttcccctgggctagctacaacgagtatacat

SEQ ID NO: 16999 - DNA, 31 bp, Artificial Sequence
  Description of Artificial Sequence:  Enzymatic Nucleic Acid
ctggaggaggctagctacaacgattcttccc

SEQ ID NO: 17000 - DNA, 31 bp, Artificial Sequence
  Description of Artificial Sequence:  Enzymatic Nucleic Acid
gattgtaaggctagctacaacgattctttct

SEQ ID NO: 17001 - DNA, 31 bp, Artificial Sequence
  Description of Artificial Sequence:  Enzymatic Nucleic Acid
tctgattgggctagctacaacgaaatttctt

SEQ ID NO: 17002 - DNA, 31 bp, Artificial Sequence
  Description of Artificial Sequence:  Enzymatic Nucleic Acid
atctctgaggctagctacaacgatgtaattt

SEQ ID NO: 17003 - DNA, 31 bp, Artificial Sequence
  Description of Artificial Sequence:  Enzymatic Nucleic Acid
cttcctgaggctagctacaacgactctgatt

SEQ ID NO: 17004 - DNA, 31 bp, Artificial Sequence
  Description of Artificial Sequence:  Enzymatic Nucleic Acid
gtatggtgggctagctacaacgattcctgat

SEQ ID NO: 17005 - DNA, 31 bp, Artificial Sequence
  Description of Artificial Sequence:  Enzymatic Nucleic Acid
aggtatggggctagctacaacgagcttcctg

SEQ ID NO: 17006 - DNA, 31 bp, Artificial Sequence
  Description of Artificial Sequence:  Enzymatic Nucleic Acid
aggaggtaggctagctacaacgaggtgcttc

SEQ ID NO: 17007 - DNA, 31 bp, Artificial Sequence
  Description of Artificial Sequence:  Enzymatic Nucleic Acid
gcaggaggggctagctacaacgaatggtgct

SEQ ID NO: 17008 - DNA, 31 bp, Artificial Sequence
  Description of Artificial Sequence:  Enzymatic Nucleic Acid
aggtttcgggctagctacaacgaaggaggta

SEQ ID NO: 17009 - DNA, 31 bp, Artificial Sequence
  Description of Artificial Sequence:  Enzymatic Nucleic Acid
cactgaggggctagctacaacgattcgcagg

SEQ ID NO: 17010 - DNA, 31 bp, Artificial Sequence
  Description of Artificial Sequence:  Enzymatic Nucleic Acid
tgtgatcaggctagctacaacgatgaggttt

SEQ ID NO: 17011 - DNA, 31 bp, Artificial Sequence
  Description of Artificial Sequence:  Enzymatic Nucleic Acid
ctgtgtgaggctagctacaacgacactgagg

SEQ ID NO: 17012 - DNA, 31 bp, Artificial Sequence
  Description of Artificial Sequence:  Enzymatic Nucleic Acid
ccactgtgggctagctacaacgagatcactg

SEQ ID NO: 17013 - DNA, 31 bp, Artificial Sequence
  Description of Artificial Sequence:  Enzymatic Nucleic Acid
ggccactgggctagctacaacgagtgatcac

SEQ ID NO: 17014 - DNA, 31 bp, Artificial Sequence
  Description of Artificial Sequence:  Enzymatic Nucleic Acid
gatggccaggctagctacaacgatgtgtgat

SEQ ID NO: 17015 - DNA, 31 bp, Artificial Sequence
  Description of Artificial Sequence:  Enzymatic Nucleic Acid
gctgatggggctagctacaacgacactgtgt

SEQ ID NO: 17016 - DNA, 31 bp, Artificial Sequence
  Description of Artificial Sequence:  Enzymatic Nucleic Acid
actgctgaggctagctacaacgaggccactg

SEQ ID NO: 17017 - DNA, 31 bp, Artificial Sequence
  Description of Artificial Sequence:  Enzymatic Nucleic Acid
tggaactgggctagctacaacgatgatggcc

SEQ ID NO: 17018 - DNA, 31 bp, Artificial Sequence
  Description of Artificial Sequence:  Enzymatic Nucleic Acid
tggtggaaggctagctacaacgatgctgatg

SEQ ID NO: 17019 - DNA, 31 bp, Artificial Sequence
  Description of Artificial Sequence:  Enzymatic Nucleic Acid
taaagtggggctagctacaacgaggaactgc

SEQ ID NO: 17020 - DNA, 31 bp, Artificial Sequence
  Description of Artificial Sequence:  Enzymatic Nucleic Acid
gtctaaagggctagctacaacgaggtggaac

SEQ ID NO: 17021 - DNA, 31 bp, Artificial Sequence
  Description of Artificial Sequence:  Enzymatic Nucleic Acid
catgacagggctagctacaacgactaaagtg

SEQ ID NO: 17022 - DNA, 31 bp, Artificial Sequence
  Description of Artificial Sequence:  Enzymatic Nucleic Acid
tagcatgaggctagctacaacgaagtctaaa

SEQ ID NO: 17023 - DNA, 31 bp, Artificial Sequence
  Description of Artificial Sequence:  Enzymatic Nucleic Acid
cattagcaggctagctacaacgagacagtct

SEQ ID NO: 17024 - DNA, 31 bp, Artificial Sequence
  Description of Artificial Sequence:  Enzymatic Nucleic Acid
accattagggctagctacaacgaatgacagt

SEQ ID NO: 17025 - DNA, 31 bp, Artificial Sequence
  Description of Artificial Sequence:  Enzymatic Nucleic Acid
ggacaccaggctagctacaacgatagcatga

SEQ ID NO: 17026 - DNA, 31 bp, Artificial Sequence
  Description of Artificial Sequence:  Enzymatic Nucleic Acid
cggggacaggctagctacaacgacattagca

SEQ ID NO: 17027 - DNA, 31 bp, Artificial Sequence
  Description of Artificial Sequence:  Enzymatic Nucleic Acid
ctcggggaggctagctacaacgaaccattag

SEQ ID NO: 17028 - DNA, 31 bp, Artificial Sequence
  Description of Artificial Sequence:  Enzymatic Nucleic Acid
atctgaggggctagctacaacgatcggggac

SEQ ID NO: 17029 - DNA, 31 bp, Artificial Sequence
  Description of Artificial Sequence:  Enzymatic Nucleic Acid
ccaagtgaggctagctacaacgactgaggct

SEQ ID NO: 17030 - DNA, 31 bp, Artificial Sequence
  Description of Artificial Sequence:  Enzymatic Nucleic Acid
aaaccaagggctagctacaacgagatctgag

SEQ ID NO: 17031 - DNA, 31 bp, Artificial Sequence
  Description of Artificial Sequence:  Enzymatic Nucleic Acid
tttttaaaggctagctacaacgacaagtgat

SEQ ID NO: 17032 - DNA, 31 bp, Artificial Sequence
  Description of Artificial Sequence:  Enzymatic Nucleic Acid
tgtggttgggctagctacaacgattttaaac

SEQ ID NO: 17033 - DNA, 31 bp, Artificial Sequence
  Description of Artificial Sequence:  Enzymatic Nucleic Acid
ttttgtggggctagctacaacgatgttttta

SEQ ID NO: 17034 - DNA, 31 bp, Artificial Sequence
  Description of Artificial Sequence:  Enzymatic Nucleic Acid
gtattttgggctagctacaacgaggttgttt

SEQ ID NO: 17035 - DNA, 31 bp, Artificial Sequence
  Description of Artificial Sequence:  Enzymatic Nucleic Acid
ttgttgtaggctagctacaacgatttgtggt

SEQ ID NO: 17036 - DNA, 31 bp, Artificial Sequence
  Description of Artificial Sequence:  Enzymatic Nucleic Acid
tcttgttgggctagctacaacgaattttgtg

SEQ ID NO: 17037 - DNA, 31 bp, Artificial Sequence
  Description of Artificial Sequence:  Enzymatic Nucleic Acid
ggctcttgggctagctacaacgatgtatttt

SEQ ID NO: 17038 - DNA, 31 bp, Artificial Sequence
  Description of Artificial Sequence:  Enzymatic Nucleic Acid
attccaggggctagctacaacgatcttgttg

SEQ ID NO: 17039 - DNA, 31 bp, Artificial Sequence
  Description of Artificial Sequence:  Enzymatic Nucleic Acid
taaaataaggctagctacaacgatccaggct

SEQ ID NO: 17040 - DNA, 31 bp, Artificial Sequence
  Description of Artificial Sequence:  Enzymatic Nucleic Acid
tcctaaaaggctagctacaacgaaattccag

SEQ ID NO: 17041 - DNA, 31 bp, Artificial Sequence
  Description of Artificial Sequence:  Enzymatic Nucleic Acid
cttcctggggctagctacaacgacctaaaat

SEQ ID NO: 17042 - DNA, 31 bp, Artificial Sequence
  Description of Artificial Sequence:  Enzymatic Nucleic Acid
gcgtgctgggctagctacaacgattcctggt

SEQ ID NO: 17043 - DNA, 31 bp, Artificial Sequence
  Description of Artificial Sequence:  Enzymatic Nucleic Acid
acagcgtgggctagctacaacgatgcttcct

SEQ ID NO: 17044 - DNA, 31 bp, Artificial Sequence
  Description of Artificial Sequence:  Enzymatic Nucleic Acid
aaacagcgggctagctacaacgagctgcttc

SEQ ID NO: 17045 - DNA, 31 bp, Artificial Sequence
  Description of Artificial Sequence:  Enzymatic Nucleic Acid
ataaacagggctagctacaacgagtgctgct

SEQ ID NO: 17046 - DNA, 31 bp, Artificial Sequence
  Description of Artificial Sequence:  Enzymatic Nucleic Acid
tcaataaaggctagctacaacgaagcgtgct

SEQ ID NO: 17047 - DNA, 31 bp, Artificial Sequence
  Description of Artificial Sequence:  Enzymatic Nucleic Acid
tctttcaaggctagctacaacgaaaacagcg

SEQ ID NO: 17048 - DNA, 31 bp, Artificial Sequence
  Description of Artificial Sequence:  Enzymatic Nucleic Acid
ttctgtgaggctagctacaacgatctttcaa

SEQ ID NO: 17049 - DNA, 31 bp, Artificial Sequence
  Description of Artificial Sequence:  Enzymatic Nucleic Acid
ctcttctgggctagctacaacgagactcttt

SEQ ID NO: 17050 - DNA, 31 bp, Artificial Sequence
  Description of Artificial Sequence:  Enzymatic Nucleic Acid
caccttcaggctagctacaacgacctcttct

SEQ ID NO: 17051 - DNA, 31 bp, Artificial Sequence
  Description of Artificial Sequence:  Enzymatic Nucleic Acid
gatagacaggctagctacaacgacttcatcc

SEQ ID NO: 17052 - DNA, 31 bp, Artificial Sequence
  Description of Artificial Sequence:  Enzymatic Nucleic Acid
gtgatagaggctagctacaacgaaccttcat

SEQ ID NO: 17053 - DNA, 31 bp, Artificial Sequence
  Description of Artificial Sequence:  Enzymatic Nucleic Acid
tgcagtgaggctagctacaacgaagacacct

SEQ ID NO: 17054 - DNA, 31 bp, Artificial Sequence
  Description of Artificial Sequence:  Enzymatic Nucleic Acid
ctttgcagggctagctacaacgagatagaca

SEQ ID NO: 17055 - DNA, 31 bp, Artificial Sequence
  Description of Artificial Sequence:  Enzymatic Nucleic Acid
tggctttgggctagctacaacgaagtgatag

SEQ ID NO: 17056 - DNA, 31 bp, Artificial Sequence
  Description of Artificial Sequence:  Enzymatic Nucleic Acid
gttggtggggctagctacaacgatttgcagt

SEQ ID NO: 17057 - DNA, 31 bp, Artificial Sequence
  Description of Artificial Sequence:  Enzymatic Nucleic Acid
ctggttggggctagctacaacgaggctttgc

SEQ ID NO: 17058 - DNA, 31 bp, Artificial Sequence
  Description of Artificial Sequence:  Enzymatic Nucleic Acid
ccttctggggctagctacaacgatggtggct

SEQ ID NO: 17059 - DNA, 31 bp, Artificial Sequence
  Description of Artificial Sequence:  Enzymatic Nucleic Acid
ccacagagggctagctacaacgaccttctgg

SEQ ID NO: 17060 - DNA, 31 bp, Artificial Sequence
  Description of Artificial Sequence:  Enzymatic Nucleic Acid
actttccaggctagctacaacgaagagccct

SEQ ID NO: 17061 - DNA, 31 bp, Artificial Sequence
  Description of Artificial Sequence:  Enzymatic Nucleic Acid
atgctgaaggctagctacaacgatttccaca

SEQ ID NO: 17062 - DNA, 31 bp, Artificial Sequence
  Description of Artificial Sequence:  Enzymatic Nucleic Acid
gaggtatgggctagctacaacgatgaacttt

SEQ ID NO: 17063 - DNA, 31 bp, Artificial Sequence
  Description of Artificial Sequence:  Enzymatic Nucleic Acid
gtgaggtaggctagctacaacgagctgaact

SEQ ID NO: 17064 - DNA, 31 bp, Artificial Sequence
  Description of Artificial Sequence:  Enzymatic Nucleic Acid
cagtgaggggctagctacaacgaatgctgaa

SEQ ID NO: 17065 - DNA, 31 bp, Artificial Sequence
  Description of Artificial Sequence:  Enzymatic Nucleic Acid
ttgaacagggctagctacaacgagaggtatg

SEQ ID NO: 17066 - DNA, 31 bp, Artificial Sequence
  Description of Artificial Sequence:  Enzymatic Nucleic Acid
tccttgaaggctagctacaacgaagtgaggt

SEQ ID NO: 17067 - DNA, 31 bp, Artificial Sequence
  Description of Artificial Sequence:  Enzymatic Nucleic Acid
gtccgaggggctagctacaacgatccttgaa

SEQ ID NO: 17068 - DNA, 31 bp, Artificial Sequence
  Description of Artificial Sequence:  Enzymatic Nucleic Acid
tagacttgggctagctacaacgaccgaggtt

SEQ ID NO: 17069 - DNA, 31 bp, Artificial Sequence
  Description of Artificial Sequence:  Enzymatic Nucleic Acid
agattagaggctagctacaacgattgtccga

SEQ ID NO: 17070 - DNA, 31 bp, Artificial Sequence
  Description of Artificial Sequence:  Enzymatic Nucleic Acid
gctccagaggctagctacaacgatagacttg

SEQ ID NO: 17071 - DNA, 31 bp, Artificial Sequence
  Description of Artificial Sequence:  Enzymatic Nucleic Acid
gtgatcagggctagctacaacgatccagatt

SEQ ID NO: 17072 - DNA, 31 bp, Artificial Sequence
  Description of Artificial Sequence:  Enzymatic Nucleic Acid
tagagtgaggctagctacaacgacagctcca

SEQ ID NO: 17073 - DNA, 31 bp, Artificial Sequence
  Description of Artificial Sequence:  Enzymatic Nucleic Acid
tgttagagggctagctacaacgagatcagct

SEQ ID NO: 17074 - DNA, 31 bp, Artificial Sequence
  Description of Artificial Sequence:  Enzymatic Nucleic Acid
ggtgcatgggctagctacaacgatagagtga

SEQ ID NO: 17075 - DNA, 31 bp, Artificial Sequence
  Description of Artificial Sequence:  Enzymatic Nucleic Acid
caggtgcaggctagctacaacgagttagagt

SEQ ID NO: 17076 - DNA, 31 bp, Artificial Sequence
  Description of Artificial Sequence:  Enzymatic Nucleic Acid
cacaggtgggctagctacaacgaatgttaga

SEQ ID NO: 17077 - DNA, 31 bp, Artificial Sequence
  Description of Artificial Sequence:  Enzymatic Nucleic Acid
cacacaggggctagctacaacgagcatgtta

SEQ ID NO: 17078 - DNA, 31 bp, Artificial Sequence
  Description of Artificial Sequence:  Enzymatic Nucleic Acid
cagccacaggctagctacaacgaaggtgcat

SEQ ID NO: 17079 - DNA, 31 bp, Artificial Sequence
  Description of Artificial Sequence:  Enzymatic Nucleic Acid
cgcagccaggctagctacaacgaacaggtgc

SEQ ID NO: 17080 - DNA, 31 bp, Artificial Sequence
  Description of Artificial Sequence:  Enzymatic Nucleic Acid
agtcgcagggctagctacaacgacacacagg

SEQ ID NO: 17081 - DNA, 31 bp, Artificial Sequence
  Description of Artificial Sequence:  Enzymatic Nucleic Acid
gagagtcgggctagctacaacgaagccacac

SEQ ID NO: 17082 - DNA, 31 bp, Artificial Sequence
  Description of Artificial Sequence:  Enzymatic Nucleic Acid
gaagagagggctagctacaacgacgcagcca

SEQ ID NO: 17083 - DNA, 31 bp, Artificial Sequence
  Description of Artificial Sequence:  Enzymatic Nucleic Acid
aataggagggctagctacaacgacagaagag

SEQ ID NO: 17084 - DNA, 31 bp, Artificial Sequence
  Description of Artificial Sequence:  Enzymatic Nucleic Acid
agggttaaggctagctacaacgaaggagcca

SEQ ID NO: 17085 - DNA, 31 bp, Artificial Sequence
  Description of Artificial Sequence:  Enzymatic Nucleic Acid
aaggagggggctagctacaacgataatagga

SEQ ID NO: 17086 - DNA, 31 bp, Artificial Sequence
  Description of Artificial Sequence:  Enzymatic Nucleic Acid
ttttcggaggctagctacaacgaaaggaggg

SEQ ID NO: 17087 - DNA, 31 bp, Artificial Sequence
  Description of Artificial Sequence:  Enzymatic Nucleic Acid
ccttttcaggctagctacaacgattttcgga

SEQ ID NO: 17088 - DNA, 31 bp, Artificial Sequence
  Description of Artificial Sequence:  Enzymatic Nucleic Acid
gaagaagaggctagctacaacgacttttcat

SEQ ID NO: 17089 - DNA, 31 bp, Artificial Sequence
  Description of Artificial Sequence:  Enzymatic Nucleic Acid
agtctttaggctagctacaacgattcagaag

SEQ ID NO: 17090 - DNA, 31 bp, Artificial Sequence
  Description of Artificial Sequence:  Enzymatic Nucleic Acid
gtagtcagggctagctacaacgactttattt

SEQ ID NO: 17091 - DNA, 31 bp, Artificial Sequence
  Description of Artificial Sequence:  Enzymatic Nucleic Acid
ataggtagggctagctacaacgacagtcttt

SEQ ID NO: 17092 - DNA, 31 bp, Artificial Sequence
  Description of Artificial Sequence:  Enzymatic Nucleic Acid
ttgataggggctagctacaacgaagtcagtc

SEQ ID NO: 17093 - DNA, 31 bp, Artificial Sequence
  Description of Artificial Sequence:  Enzymatic Nucleic Acid
ataattgaggctagctacaacgaaggtagtc

SEQ ID NO: 17094 - DNA, 31 bp, Artificial Sequence
  Description of Artificial Sequence:  Enzymatic Nucleic Acid
cattataaggctagctacaacgatgataggt

SEQ ID NO: 17095 - DNA, 31 bp, Artificial Sequence
  Description of Artificial Sequence:  Enzymatic Nucleic Acid
gtccattaggctagctacaacgaaattgata

SEQ ID NO: 17096 - DNA, 31 bp, Artificial Sequence
  Description of Artificial Sequence:  Enzymatic Nucleic Acid
tgggtccaggctagctacaacgatataattg

SEQ ID NO: 17097 - DNA, 31 bp, Artificial Sequence
  Description of Artificial Sequence:  Enzymatic Nucleic Acid
catctgggggctagctacaacgaccattata

SEQ ID NO: 17098 - DNA, 31 bp, Artificial Sequence
  Description of Artificial Sequence:  Enzymatic Nucleic Acid
gaacttcaggctagctacaacgactgggtcc

SEQ ID NO: 17099 - DNA, 31 bp, Artificial Sequence
  Description of Artificial Sequence:  Enzymatic Nucleic Acid
caaaggaaggctagctacaacgattcatctg

SEQ ID NO: 17100 - DNA, 31 bp, Artificial Sequence
  Description of Artificial Sequence:  Enzymatic Nucleic Acid
actgctcaggctagctacaacgaccaaagga

SEQ ID NO: 17101 - DNA, 31 bp, Artificial Sequence
  Description of Artificial Sequence:  Enzymatic Nucleic Acid
tcacactgggctagctacaacgatcatccaa

SEQ ID NO: 17102 - DNA, 31 bp, Artificial Sequence
  Description of Artificial Sequence:  Enzymatic Nucleic Acid
cgctcacaggctagctacaacgatgctcatc

SEQ ID NO: 17103 - DNA, 31 bp, Artificial Sequence
  Description of Artificial Sequence:  Enzymatic Nucleic Acid
gccgctcaggctagctacaacgaactgctca

SEQ ID NO: 17104 - DNA, 31 bp, Artificial Sequence
  Description of Artificial Sequence:  Enzymatic Nucleic Acid
gggagccgggctagctacaacgatcacactg

SEQ ID NO: 17105 - DNA, 31 bp, Artificial Sequence
  Description of Artificial Sequence:  Enzymatic Nucleic Acid
taagggagggctagctacaacgacgctcaca

SEQ ID NO: 17106 - DNA, 31 bp, Artificial Sequence
  Description of Artificial Sequence:  Enzymatic Nucleic Acid
tggcatcaggctagctacaacgaaagggagc

SEQ ID NO: 17107 - DNA, 31 bp, Artificial Sequence
  Description of Artificial Sequence:  Enzymatic Nucleic Acid
tgctggcaggctagctacaacgacataaggg

SEQ ID NO: 17108 - DNA, 31 bp, Artificial Sequence
  Description of Artificial Sequence:  Enzymatic Nucleic Acid
cttgctggggctagctacaacgaatcataag

SEQ ID NO: 17109 - DNA, 31 bp, Artificial Sequence
  Description of Artificial Sequence:  Enzymatic Nucleic Acid
cccacttgggctagctacaacgatggcatca

SEQ ID NO: 17110 - DNA, 31 bp, Artificial Sequence
  Description of Artificial Sequence:  Enzymatic Nucleic Acid
aactcccaggctagctacaacgattgctggc

SEQ ID NO: 17111 - DNA, 31 bp, Artificial Sequence
  Description of Artificial Sequence:  Enzymatic Nucleic Acid
cgggcaaaggctagctacaacgatcccactt

SEQ ID NO: 17112 - DNA, 31 bp, Artificial Sequence
  Description of Artificial Sequence:  Enzymatic Nucleic Acid
ctcccgggggctagctacaacgaaaactccc

SEQ ID NO: 17113 - DNA, 31 bp, Artificial Sequence
  Description of Artificial Sequence:  Enzymatic Nucleic Acid
agtttaagggctagctacaacgactctcccg

SEQ ID NO: 17114 - DNA, 31 bp, Artificial Sequence
  Description of Artificial Sequence:  Enzymatic Nucleic Acid
ttgcccagggctagctacaacgattaagtct

SEQ ID NO: 17115 - DNA, 31 bp, Artificial Sequence
  Description of Artificial Sequence:  Enzymatic Nucleic Acid
gtgatttgggctagctacaacgaccagttta

SEQ ID NO: 17116 - DNA, 31 bp, Artificial Sequence
  Description of Artificial Sequence:  Enzymatic Nucleic Acid
ccaagtgaggctagctacaacgattgcccag

SEQ ID NO: 17117 - DNA, 31 bp, Artificial Sequence
  Description of Artificial Sequence:  Enzymatic Nucleic Acid
cttccaagggctagctacaacgagatttgcc

SEQ ID NO: 17118 - DNA, 31 bp, Artificial Sequence
  Description of Artificial Sequence:  Enzymatic Nucleic Acid
tccaaaagggctagctacaacgaccctcttc

SEQ ID NO: 17119 - DNA, 31 bp, Artificial Sequence
  Description of Artificial Sequence:  Enzymatic Nucleic Acid
ttgaaccaggctagctacaacgattttccaa

SEQ ID NO: 17120 - DNA, 31 bp, Artificial Sequence
  Description of Artificial Sequence:  Enzymatic Nucleic Acid
tgcttgaaggctagctacaacgacacttttc

SEQ ID NO: 17121 - DNA, 31 bp, Artificial Sequence
  Description of Artificial Sequence:  Enzymatic Nucleic Acid
tgctgatgggctagctacaacgattgaacca

SEQ ID NO: 17122 - DNA, 31 bp, Artificial Sequence
  Description of Artificial Sequence:  Enzymatic Nucleic Acid
aatgctgaggctagctacaacgagcttgaac

SEQ ID NO: 17123 - DNA, 31 bp, Artificial Sequence
  Description of Artificial Sequence:  Enzymatic Nucleic Acid
gccaaatgggctagctacaacgatgatgctt

SEQ ID NO: 17124 - DNA, 31 bp, Artificial Sequence
  Description of Artificial Sequence:  Enzymatic Nucleic Acid
atgccaaaggctagctacaacgagctgatgc

SEQ ID NO: 17125 - DNA, 31 bp, Artificial Sequence
  Description of Artificial Sequence:  Enzymatic Nucleic Acid
tcttaatgggctagctacaacgacaaatgct

SEQ ID NO: 17126 - DNA, 31 bp, Artificial Sequence
  Description of Artificial Sequence:  Enzymatic Nucleic Acid
tttcttaaggctagctacaacgagccaaatg

SEQ ID NO: 17127 - DNA, 31 bp, Artificial Sequence
  Description of Artificial Sequence:  Enzymatic Nucleic Acid
gtaggtgaggctagctacaacgattcttaat

SEQ ID NO: 17128 - DNA, 31 bp, Artificial Sequence
  Description of Artificial Sequence:  Enzymatic Nucleic Acid
cacgtaggggctagctacaacgagatttctt

SEQ ID NO: 17129 - DNA, 31 bp, Artificial Sequence
  Description of Artificial Sequence:  Enzymatic Nucleic Acid
ccggcacgggctagctacaacgaaggtgatt

SEQ ID NO: 17130 - DNA, 31 bp, Artificial Sequence
  Description of Artificial Sequence:  Enzymatic Nucleic Acid
gtccggcaggctagctacaacgagtaggtga

SEQ ID NO: 17131 - DNA, 31 bp, Artificial Sequence
  Description of Artificial Sequence:  Enzymatic Nucleic Acid
cagtccggggctagctacaacgaacgtaggt

SEQ ID NO: 17132 - DNA, 31 bp, Artificial Sequence
  Description of Artificial Sequence:  Enzymatic Nucleic Acid
agccacagggctagctacaacgaccggcacg

SEQ ID NO: 17133 - DNA, 31 bp, Artificial Sequence
  Description of Artificial Sequence:  Enzymatic Nucleic Acid
cacagccaggctagctacaacgaagtccggc

SEQ ID NO: 17134 - DNA, 31 bp, Artificial Sequence
  Description of Artificial Sequence:  Enzymatic Nucleic Acid
tttcacagggctagctacaacgacacagtcc

SEQ ID NO: 17135 - DNA, 31 bp, Artificial Sequence
  Description of Artificial Sequence:  Enzymatic Nucleic Acid
cattttcaggctagctacaacgaagccacag

SEQ ID NO: 17136 - DNA, 31 bp, Artificial Sequence
  Description of Artificial Sequence:  Enzymatic Nucleic Acid
tttcagcaggctagctacaacgatttcacag

SEQ ID NO: 17137 - DNA, 31 bp, Artificial Sequence
  Description of Artificial Sequence:  Enzymatic Nucleic Acid
tctttcagggctagctacaacgaattttcac

SEQ ID NO: 17138 - DNA, 31 bp, Artificial Sequence
  Description of Artificial Sequence:  Enzymatic Nucleic Acid
ggccgtggggctagctacaacgacccctctt

SEQ ID NO: 17139 - DNA, 31 bp, Artificial Sequence
  Description of Artificial Sequence:  Enzymatic Nucleic Acid
gctggccgggctagctacaacgaggccccct

SEQ ID NO: 17140 - DNA, 31 bp, Artificial Sequence
  Description of Artificial Sequence:  Enzymatic Nucleic Acid
ctcgctggggctagctacaacgacgtggccc

SEQ ID NO: 17141 - DNA, 31 bp, Artificial Sequence
  Description of Artificial Sequence:  Enzymatic Nucleic Acid
tgtactcgggctagctacaacgatggccgtg

SEQ ID NO: 17142 - DNA, 31 bp, Artificial Sequence
  Description of Artificial Sequence:  Enzymatic Nucleic Acid
gctttgtaggctagctacaacgatcgctggc

SEQ ID NO: 17143 - DNA, 31 bp, Artificial Sequence
  Description of Artificial Sequence:  Enzymatic Nucleic Acid
gagctttgggctagctacaacgaactcgctg

SEQ ID NO: 17144 - DNA, 31 bp, Artificial Sequence
  Description of Artificial Sequence:  Enzymatic Nucleic Acid
catcagagggctagctacaacgatttgtact

SEQ ID NO: 17145 - DNA, 31 bp, Artificial Sequence
  Description of Artificial Sequence:  Enzymatic Nucleic Acid
ctcagtcaggctagctacaacgacagagctt

SEQ ID NO: 17146 - DNA, 31 bp, Artificial Sequence
  Description of Artificial Sequence:  Enzymatic Nucleic Acid
tagctcagggctagctacaacgacatcagag

SEQ ID NO: 17147 - DNA, 31 bp, Artificial Sequence
  Description of Artificial Sequence:  Enzymatic Nucleic Acid
atttttagggctagctacaacgatcagtcat

SEQ ID NO: 17148 - DNA, 31 bp, Artificial Sequence
  Description of Artificial Sequence:  Enzymatic Nucleic Acid
ggtcaagaggctagctacaacgattttagct

SEQ ID NO: 17149 - DNA, 31 bp, Artificial Sequence
  Description of Artificial Sequence:  Enzymatic Nucleic Acid
aatgtgggggctagctacaacgacaagattt

SEQ ID NO: 17150 - DNA, 31 bp, Artificial Sequence
  Description of Artificial Sequence:  Enzymatic Nucleic Acid
ggccaatgggctagctacaacgagggtcaag

SEQ ID NO: 17151 - DNA, 31 bp, Artificial Sequence
  Description of Artificial Sequence:  Enzymatic Nucleic Acid
gtggccaaggctagctacaacgagtgggtca

SEQ ID NO: 17152 - DNA, 31 bp, Artificial Sequence
  Description of Artificial Sequence:  Enzymatic Nucleic Acid
gatggtggggctagctacaacgacaatgtgg

SEQ ID NO: 17153 - DNA, 31 bp, Artificial Sequence
  Description of Artificial Sequence:  Enzymatic Nucleic Acid
tcagatggggctagctacaacgaggccaatg

SEQ ID NO: 17154 - DNA, 31 bp, Artificial Sequence
  Description of Artificial Sequence:  Enzymatic Nucleic Acid
cgttcagaggctagctacaacgaggtggcca

SEQ ID NO: 17155 - DNA, 31 bp, Artificial Sequence
  Description of Artificial Sequence:  Enzymatic Nucleic Acid
taaccacgggctagctacaacgatcagatgg

SEQ ID NO: 17156 - DNA, 31 bp, Artificial Sequence
  Description of Artificial Sequence:  Enzymatic Nucleic Acid
gttaaccaggctagctacaacgagttcagat

SEQ ID NO: 17157 - DNA, 31 bp, Artificial Sequence
  Description of Artificial Sequence:  Enzymatic Nucleic Acid
caggttaaggctagctacaacgacacgttca

SEQ ID NO: 17158 - DNA, 31 bp, Artificial Sequence
  Description of Artificial Sequence:  Enzymatic Nucleic Acid
ccagcaggggctagctacaacgataaccacg

SEQ ID NO: 17159 - DNA, 31 bp, Artificial Sequence
  Description of Artificial Sequence:  Enzymatic Nucleic Acid
gctcccagggctagctacaacgaaggttaac

SEQ ID NO: 17160 - DNA, 31 bp, Artificial Sequence
  Description of Artificial Sequence:  Enzymatic Nucleic Acid
ggtgcaggggctagctacaacgatcccagca

SEQ ID NO: 17161 - DNA, 31 bp, Artificial Sequence
  Description of Artificial Sequence:  Enzymatic Nucleic Acid
gcttggtgggctagctacaacgaaggctccc

SEQ ID NO: 17162 - DNA, 31 bp, Artificial Sequence
  Description of Artificial Sequence:  Enzymatic Nucleic Acid
ttgcttggggctagctacaacgagcaggctc

SEQ ID NO: 17163 - DNA, 31 bp, Artificial Sequence
  Description of Artificial Sequence:  Enzymatic Nucleic Acid
cctccttgggctagctacaacgattggtgca

SEQ ID NO: 17164 - DNA, 31 bp, Artificial Sequence
  Description of Artificial Sequence:  Enzymatic Nucleic Acid
atcagaggggctagctacaacgacctccttg

SEQ ID NO: 17165 - DNA, 31 bp, Artificial Sequence
  Description of Artificial Sequence:  Enzymatic Nucleic Acid
aatcaccaggctagctacaacgacagaggcc

SEQ ID NO: 17166 - DNA, 31 bp, Artificial Sequence
  Description of Artificial Sequence:  Enzymatic Nucleic Acid
aacaatcaggctagctacaacgacatcagag

SEQ ID NO: 17167 - DNA, 31 bp, Artificial Sequence
  Description of Artificial Sequence:  Enzymatic Nucleic Acid
ttcaacaaggctagctacaacgacaccatca

SEQ ID NO: 17168 - DNA, 31 bp, Artificial Sequence
  Description of Artificial Sequence:  Enzymatic Nucleic Acid
gtattcaaggctagctacaacgaaatcacca

SEQ ID NO: 17169 - DNA, 31 bp, Artificial Sequence
  Description of Artificial Sequence:  Enzymatic Nucleic Acid
ttgcagtaggctagctacaacgatcaacaat

SEQ ID NO: 17170 - DNA, 31 bp, Artificial Sequence
  Description of Artificial Sequence:  Enzymatic Nucleic Acid
atttgcagggctagctacaacgaattcaaca

SEQ ID NO: 17171 - DNA, 31 bp, Artificial Sequence
  Description of Artificial Sequence:  Enzymatic Nucleic Acid
catatttgggctagctacaacgaagtattca

SEQ ID NO: 17172 - DNA, 31 bp, Artificial Sequence
  Description of Artificial Sequence:  Enzymatic Nucleic Acid
tttccataggctagctacaacgattgcagta

SEQ ID NO: 17173 - DNA, 31 bp, Artificial Sequence
  Description of Artificial Sequence:  Enzymatic Nucleic Acid
gatttccaggctagctacaacgaatttgcag

SEQ ID NO: 17174 - DNA, 31 bp, Artificial Sequence
  Description of Artificial Sequence:  Enzymatic Nucleic Acid
tggagagaggctagctacaacgattccatat

SEQ ID NO: 17175 - DNA, 31 bp, Artificial Sequence
  Description of Artificial Sequence:  Enzymatic Nucleic Acid
tgaggtagggctagctacaacgatggagaga

SEQ ID NO: 17176 - DNA, 31 bp, Artificial Sequence
  Description of Artificial Sequence:  Enzymatic Nucleic Acid
tcttgaggggctagctacaacgaagttggag

SEQ ID NO: 17177 - DNA, 31 bp, Artificial Sequence
  Description of Artificial Sequence:  Enzymatic Nucleic Acid
cacgtttgggctagctacaacgatcttgagg

SEQ ID NO: 17178 - DNA, 31 bp, Artificial Sequence
  Description of Artificial Sequence:  Enzymatic Nucleic Acid
aagtcacgggctagctacaacgattgctctt

SEQ ID NO: 17179 - DNA, 31 bp, Artificial Sequence
  Description of Artificial Sequence:  Enzymatic Nucleic Acid
ataagtcaggctagctacaacgagtttgctc

SEQ ID NO: 17180 - DNA, 31 bp, Artificial Sequence
  Description of Artificial Sequence:  Enzymatic Nucleic Acid
aaaataagggctagctacaacgacacgtttg

SEQ ID NO: 17181 - DNA, 31 bp, Artificial Sequence
  Description of Artificial Sequence:  Enzymatic Nucleic Acid
agaaaaaaggctagctacaacgaaagtcacg

SEQ ID NO: 17182 - DNA, 31 bp, Artificial Sequence
  Description of Artificial Sequence:  Enzymatic Nucleic Acid
catccttgggctagctacaacgatgagaaaa

SEQ ID NO: 17183 - DNA, 31 bp, Artificial Sequence
  Description of Artificial Sequence:  Enzymatic Nucleic Acid
gtgctgcaggctagctacaacgaccttgttg

SEQ ID NO: 17184 - DNA, 31 bp, Artificial Sequence
  Description of Artificial Sequence:  Enzymatic Nucleic Acid
tagtgctgggctagctacaacgaatccttgt

SEQ ID NO: 17185 - DNA, 31 bp, Artificial Sequence
  Description of Artificial Sequence:  Enzymatic Nucleic Acid
gtgtagtgggctagctacaacgatgcatcct

SEQ ID NO: 17186 - DNA, 31 bp, Artificial Sequence
  Description of Artificial Sequence:  Enzymatic Nucleic Acid
atgtgtagggctagctacaacgagctgcatc

SEQ ID NO: 17187 - DNA, 31 bp, Artificial Sequence
  Description of Artificial Sequence:  Enzymatic Nucleic Acid
tccatgtgggctagctacaacgaagtgctgc

SEQ ID NO: 17188 - DNA, 31 bp, Artificial Sequence
  Description of Artificial Sequence:  Enzymatic Nucleic Acid
gctccatgggctagctacaacgagtagtgct

SEQ ID NO: 17189 - DNA, 31 bp, Artificial Sequence
  Description of Artificial Sequence:  Enzymatic Nucleic Acid
aggctccaggctagctacaacgagtgtagtg

SEQ ID NO: 17190 - DNA, 31 bp, Artificial Sequence
  Description of Artificial Sequence:  Enzymatic Nucleic Acid
ttcttaggggctagctacaacgatccatgtg

SEQ ID NO: 17191 - DNA, 31 bp, Artificial Sequence
  Description of Artificial Sequence:  Enzymatic Nucleic Acid
tggctccaggctagctacaacgatttttctt

SEQ ID NO: 17192 - DNA, 31 bp, Artificial Sequence
  Description of Artificial Sequence:  Enzymatic Nucleic Acid
aggcctggggctagctacaacgatccatttt

SEQ ID NO: 17193 - DNA, 31 bp, Artificial Sequence
  Description of Artificial Sequence:  Enzymatic Nucleic Acid
gttccaggggctagctacaacgactggctcc

SEQ ID NO: 17194 - DNA, 31 bp, Artificial Sequence
  Description of Artificial Sequence:  Enzymatic Nucleic Acid
ttgccttgggctagctacaacgatccaggcc

SEQ ID NO: 17195 - DNA, 31 bp, Artificial Sequence
  Description of Artificial Sequence:  Enzymatic Nucleic Acid
gtttcttgggctagctacaacgacttgttcc

SEQ ID NO: 17196 - DNA, 31 bp, Artificial Sequence
  Description of Artificial Sequence:  Enzymatic Nucleic Acid
agtcttggggctagctacaacgattcttgcc

SEQ ID NO: 17197 - DNA, 31 bp, Artificial Sequence
  Description of Artificial Sequence:  Enzymatic Nucleic Acid
ctatctagggctagctacaacgacttggttt

SEQ ID NO: 17198 - DNA, 31 bp, Artificial Sequence
  Description of Artificial Sequence:  Enzymatic Nucleic Acid
tgacgctaggctagctacaacgactagtctt

SEQ ID NO: 17199 - DNA, 31 bp, Artificial Sequence
  Description of Artificial Sequence:  Enzymatic Nucleic Acid
tggtgacgggctagctacaacgatatctagt

SEQ ID NO: 17200 - DNA, 31 bp, Artificial Sequence
  Description of Artificial Sequence:  Enzymatic Nucleic Acid
gctggtgaggctagctacaacgagctatcta

SEQ ID NO: 17201 - DNA, 31 bp, Artificial Sequence
  Description of Artificial Sequence:  Enzymatic Nucleic Acid
gctgctggggctagctacaacgagacgctat

SEQ ID NO: 17202 - DNA, 31 bp, Artificial Sequence
  Description of Artificial Sequence:  Enzymatic Nucleic Acid
tttcgctgggctagctacaacgatggtgacg

SEQ ID NO: 17203 - DNA, 31 bp, Artificial Sequence
  Description of Artificial Sequence:  Enzymatic Nucleic Acid
agctttcgggctagctacaacgatgctggtg

SEQ ID NO: 17204 - DNA, 31 bp, Artificial Sequence
  Description of Artificial Sequence:  Enzymatic Nucleic Acid
tcgcaaagggctagctacaacgatttcgctg

SEQ ID NO: 17205 - DNA, 31 bp, Artificial Sequence
  Description of Artificial Sequence:  Enzymatic Nucleic Acid
ggagctcgggctagctacaacgaaaagcttt

SEQ ID NO: 17206 - DNA, 31 bp, Artificial Sequence
  Description of Artificial Sequence:  Enzymatic Nucleic Acid
agccggagggctagctacaacgatcgcaaag

SEQ ID NO: 17207 - DNA, 31 bp, Artificial Sequence
  Description of Artificial Sequence:  Enzymatic Nucleic Acid
cctgaaagggctagctacaacgacggagctc

SEQ ID NO: 17208 - DNA, 31 bp, Artificial Sequence
  Description of Artificial Sequence:  Enzymatic Nucleic Acid
gacttttaggctagctacaacgacttcctga

SEQ ID NO: 17209 - DNA, 31 bp, Artificial Sequence
  Description of Artificial Sequence:  Enzymatic Nucleic Acid
cactcagaggctagctacaacgattttatct

SEQ ID NO: 17210 - DNA, 31 bp, Artificial Sequence
  Description of Artificial Sequence:  Enzymatic Nucleic Acid
caacatcaggctagctacaacgatcagactt

SEQ ID NO: 17211 - DNA, 31 bp, Artificial Sequence
  Description of Artificial Sequence:  Enzymatic Nucleic Acid
cctcaacaggctagctacaacgacactcaga

SEQ ID NO: 17212 - DNA, 31 bp, Artificial Sequence
  Description of Artificial Sequence:  Enzymatic Nucleic Acid
ttcctcaaggctagctacaacgaatcactca

SEQ ID NO: 17213 - DNA, 31 bp, Artificial Sequence
  Description of Artificial Sequence:  Enzymatic Nucleic Acid
cgtcagaaggctagctacaacgacctcctct

SEQ ID NO: 17214 - DNA, 31 bp, Artificial Sequence
  Description of Artificial Sequence:  Enzymatic Nucleic Acid
agaaaccgggctagctacaacgacagaatcc

SEQ ID NO: 17215 - DNA, 31 bp, Artificial Sequence
  Description of Artificial Sequence:  Enzymatic Nucleic Acid
tgtagaaaggctagctacaacgacgtcagaa

SEQ ID NO: 17216 - DNA, 31 bp, Artificial Sequence
  Description of Artificial Sequence:  Enzymatic Nucleic Acid
gctccttgggctagctacaacgaagaaaccg

SEQ ID NO: 17217 - DNA, 31 bp, Artificial Sequence
  Description of Artificial Sequence:  Enzymatic Nucleic Acid
gtgatgggggctagctacaacgatccttgta

SEQ ID NO: 17218 - DNA, 31 bp, Artificial Sequence
  Description of Artificial Sequence:  Enzymatic Nucleic Acid
catagtgaggctagctacaacgagggctcct

SEQ ID NO: 17219 - DNA, 31 bp, Artificial Sequence
  Description of Artificial Sequence:  Enzymatic Nucleic Acid
ttccatagggctagctacaacgagatgggct

SEQ ID NO: 17220 - DNA, 31 bp, Artificial Sequence
  Description of Artificial Sequence:  Enzymatic Nucleic Acid
atcttccaggctagctacaacgaagtgatgg

SEQ ID NO: 17221 - DNA, 31 bp, Artificial Sequence
  Description of Artificial Sequence:  Enzymatic Nucleic Acid
aaatcagaggctagctacaacgacttccata

SEQ ID NO: 17222 - DNA, 31 bp, Artificial Sequence
  Description of Artificial Sequence:  Enzymatic Nucleic Acid
gtaagaaaggctagctacaacgacagatctt

SEQ ID NO: 17223 - DNA, 31 bp, Artificial Sequence
  Description of Artificial Sequence:  Enzymatic Nucleic Acid
gaaaactgggctagctacaacgaaagaaatc

SEQ ID NO: 17224 - DNA, 31 bp, Artificial Sequence
  Description of Artificial Sequence:  Enzymatic Nucleic Acid
cttgaaaaggctagctacaacgatgtaagaa

SEQ ID NO: 17225 - DNA, 31 bp, Artificial Sequence
  Description of Artificial Sequence:  Enzymatic Nucleic Acid
tctggccaggctagctacaacgattgaaaac

SEQ ID NO: 17226 - DNA, 31 bp, Artificial Sequence
  Description of Artificial Sequence:  Enzymatic Nucleic Acid
gcctctggggctagctacaacgacacttgaa

SEQ ID NO: 17227 - DNA, 31 bp, Artificial Sequence
  Description of Artificial Sequence:  Enzymatic Nucleic Acid
actccatgggctagctacaacgactctggcc

SEQ ID NO: 17228 - DNA, 31 bp, Artificial Sequence
  Description of Artificial Sequence:  Enzymatic Nucleic Acid
gaactccaggctagctacaacgagcctctgg

SEQ ID NO: 17229 - DNA, 31 bp, Artificial Sequence
  Description of Artificial Sequence:  Enzymatic Nucleic Acid
gacaggaaggctagctacaacgatccatgcc

SEQ ID NO: 17230 - DNA, 31 bp, Artificial Sequence
  Description of Artificial Sequence:  Enzymatic Nucleic Acid
ctggaagaggctagctacaacgaaggaactc

SEQ ID NO: 17231 - DNA, 31 bp, Artificial Sequence
  Description of Artificial Sequence:  Enzymatic Nucleic Acid
tgaatgcaggctagctacaacgatttctgga

SEQ ID NO: 17232 - DNA, 31 bp, Artificial Sequence
  Description of Artificial Sequence:  Enzymatic Nucleic Acid
gatgaatgggctagctacaacgaactttctg

SEQ ID NO: 17233 - DNA, 31 bp, Artificial Sequence
  Description of Artificial Sequence:  Enzymatic Nucleic Acid
ccgatgaaggctagctacaacgagcactttc

SEQ ID NO: 17234 - DNA, 31 bp, Artificial Sequence
  Description of Artificial Sequence:  Enzymatic Nucleic Acid
ggtcccgaggctagctacaacgagaatgcac

SEQ ID NO: 17235 - DNA, 31 bp, Artificial Sequence
  Description of Artificial Sequence:  Enzymatic Nucleic Acid
ctgccaggggctagctacaacgacccgatga

SEQ ID NO: 17236 - DNA, 31 bp, Artificial Sequence
  Description of Artificial Sequence:  Enzymatic Nucleic Acid
tctcgctgggctagctacaacgacaggtccc

SEQ ID NO: 17237 - DNA, 31 bp, Artificial Sequence
  Description of Artificial Sequence:  Enzymatic Nucleic Acid
gtttctcgggctagctacaacgatgccaggt

SEQ ID NO: 17238 - DNA, 31 bp, Artificial Sequence
  Description of Artificial Sequence:  Enzymatic Nucleic Acid
aaagaatgggctagctacaacgattctcgct

SEQ ID NO: 17239 - DNA, 31 bp, Artificial Sequence
  Description of Artificial Sequence:  Enzymatic Nucleic Acid
taaaagaaggctagctacaacgagtttctcg

SEQ ID NO: 17240 - DNA, 31 bp, Artificial Sequence
  Description of Artificial Sequence:  Enzymatic Nucleic Acid
ttctcagaggctagctacaacgaaaaagaat

SEQ ID NO: 17241 - DNA, 31 bp, Artificial Sequence
  Description of Artificial Sequence:  Enzymatic Nucleic Acid
ccacgttgggctagctacaacgatctcagat

SEQ ID NO: 17242 - DNA, 31 bp, Artificial Sequence
  Description of Artificial Sequence:  Enzymatic Nucleic Acid
tcaccacgggctagctacaacgatgttctca

SEQ ID NO: 17243 - DNA, 31 bp, Artificial Sequence
  Description of Artificial Sequence:  Enzymatic Nucleic Acid
cttcaccaggctagctacaacgagttgttct

SEQ ID NO: 17244 - DNA, 31 bp, Artificial Sequence
  Description of Artificial Sequence:  Enzymatic Nucleic Acid
aatcttcaggctagctacaacgacacgttgt

SEQ ID NO: 17245 - DNA, 31 bp, Artificial Sequence
  Description of Artificial Sequence:  Enzymatic Nucleic Acid
atcacaaaggctagctacaacgacttcacca

SEQ ID NO: 17246 - DNA, 31 bp, Artificial Sequence
  Description of Artificial Sequence:  Enzymatic Nucleic Acid
caaaatcaggctagctacaacgaaaatcttc

SEQ ID NO: 17247 - DNA, 31 bp, Artificial Sequence
  Description of Artificial Sequence:  Enzymatic Nucleic Acid
ggccaaaaggctagctacaacgacacaaatc

SEQ ID NO: 17248 - DNA, 31 bp, Artificial Sequence
  Description of Artificial Sequence:  Enzymatic Nucleic Acid
gggcaaggggctagctacaacgacaaaatca

SEQ ID NO: 17249 - DNA, 31 bp, Artificial Sequence
  Description of Artificial Sequence:  Enzymatic Nucleic Acid
atcccgggggctagctacaacgaaaggccaa

SEQ ID NO: 17250 - DNA, 31 bp, Artificial Sequence
  Description of Artificial Sequence:  Enzymatic Nucleic Acid
tataaataggctagctacaacgacccgggca

SEQ ID NO: 17251 - DNA, 31 bp, Artificial Sequence
  Description of Artificial Sequence:  Enzymatic Nucleic Acid
cttataaaggctagctacaacgaatcccggg

SEQ ID NO: 17252 - DNA, 31 bp, Artificial Sequence
  Description of Artificial Sequence:  Enzymatic Nucleic Acid
ggttcttaggctagctacaacgaaaatatcc

SEQ ID NO: 17253 - DNA, 31 bp, Artificial Sequence
  Description of Artificial Sequence:  Enzymatic Nucleic Acid
aatcggggggctagctacaacgatcttataa

SEQ ID NO: 17254 - DNA, 31 bp, Artificial Sequence
  Description of Artificial Sequence:  Enzymatic Nucleic Acid
tcacataaggctagctacaacgacggggttc

SEQ ID NO: 17255 - DNA, 31 bp, Artificial Sequence
  Description of Artificial Sequence:  Enzymatic Nucleic Acid
ttctcacaggctagctacaacgaaatcgggg

SEQ ID NO: 17256 - DNA, 31 bp, Artificial Sequence
  Description of Artificial Sequence:  Enzymatic Nucleic Acid
ttttctcaggctagctacaacgaataatcgg

SEQ ID NO: 17257 - DNA, 31 bp, Artificial Sequence
  Description of Artificial Sequence:  Enzymatic Nucleic Acid
gtcgagtaggctagctacaacgactcctttt

SEQ ID NO: 17258 - DNA, 31 bp, Artificial Sequence
  Description of Artificial Sequence:  Enzymatic Nucleic Acid
aagtcgagggctagctacaacgaatctcctt

SEQ ID NO: 17259 - DNA, 31 bp, Artificial Sequence
  Description of Artificial Sequence:  Enzymatic Nucleic Acid
agaggaagggctagctacaacgacgagtatc

SEQ ID NO: 17260 - DNA, 31 bp, Artificial Sequence
  Description of Artificial Sequence:  Enzymatic Nucleic Acid
gccatccaggctagctacaacgattcagagg

SEQ ID NO: 17261 - DNA, 31 bp, Artificial Sequence
  Description of Artificial Sequence:  Enzymatic Nucleic Acid
gggagccaggctagctacaacgaccatttca

SEQ ID NO: 17262 - DNA, 31 bp, Artificial Sequence
  Description of Artificial Sequence:  Enzymatic Nucleic Acid
ttcgggagggctagctacaacgacatccatt

SEQ ID NO: 17263 - DNA, 31 bp, Artificial Sequence
  Description of Artificial Sequence:  Enzymatic Nucleic Acid
aagatagaggctagctacaacgatcgggagc

SEQ ID NO: 17264 - DNA, 31 bp, Artificial Sequence
  Description of Artificial Sequence:  Enzymatic Nucleic Acid
gtcaaagaggctagctacaacgaagattcgg

SEQ ID NO: 17265 - DNA, 31 bp, Artificial Sequence
  Description of Artificial Sequence:  Enzymatic Nucleic Acid
agattttgggctagctacaacgacaaagata

SEQ ID NO: 17266 - DNA, 31 bp, Artificial Sequence
  Description of Artificial Sequence:  Enzymatic Nucleic Acid
gctgtagaggctagctacaacgatttgtcaa

SEQ ID NO: 17267 - DNA, 31 bp, Artificial Sequence
  Description of Artificial Sequence:  Enzymatic Nucleic Acid
tggtgctgggctagctacaacgaagattttg

SEQ ID NO: 17268 - DNA, 31 bp, Artificial Sequence
  Description of Artificial Sequence:  Enzymatic Nucleic Acid
tcttggtgggctagctacaacgatgtagatt

SEQ ID NO: 17269 - DNA, 31 bp, Artificial Sequence
  Description of Artificial Sequence:  Enzymatic Nucleic Acid
gctcttggggctagctacaacgagctgtaga

SEQ ID NO: 17270 - DNA, 31 bp, Artificial Sequence
  Description of Artificial Sequence:  Enzymatic Nucleic Acid
acacgtcgggctagctacaacgatcttggtg

SEQ ID NO: 17271 - DNA, 31 bp, Artificial Sequence
  Description of Artificial Sequence:  Enzymatic Nucleic Acid
accacacgggctagctacaacgacgctcttg

SEQ ID NO: 17272 - DNA, 31 bp, Artificial Sequence
  Description of Artificial Sequence:  Enzymatic Nucleic Acid
agaccacaggctagctacaacgagtcgctct

SEQ ID NO: 17273 - DNA, 31 bp, Artificial Sequence
  Description of Artificial Sequence:  Enzymatic Nucleic Acid
taagaccaggctagctacaacgaacgtcgct

SEQ ID NO: 17274 - DNA, 31 bp, Artificial Sequence
  Description of Artificial Sequence:  Enzymatic Nucleic Acid
ccgtaagaggctagctacaacgacacacgtc

SEQ ID NO: 17275 - DNA, 31 bp, Artificial Sequence
  Description of Artificial Sequence:  Enzymatic Nucleic Acid
atactccgggctagctacaacgaaagaccac

SEQ ID NO: 17276 - DNA, 31 bp, Artificial Sequence
  Description of Artificial Sequence:  Enzymatic Nucleic Acid
cagcaataggctagctacaacgatccgtaag

SEQ ID NO: 17277 - DNA, 31 bp, Artificial Sequence
  Description of Artificial Sequence:  Enzymatic Nucleic Acid
cacagcaaggctagctacaacgaactccgta

SEQ ID NO: 17278 - DNA, 31 bp, Artificial Sequence
  Description of Artificial Sequence:  Enzymatic Nucleic Acid
tcccacagggctagctacaacgaaatactcc

SEQ ID NO: 17279 - DNA, 31 bp, Artificial Sequence
  Description of Artificial Sequence:  Enzymatic Nucleic Acid
atttcccaggctagctacaacgaagcaatac

SEQ ID NO: 17280 - DNA, 31 bp, Artificial Sequence
  Description of Artificial Sequence:  Enzymatic Nucleic Acid
ggagaagaggctagctacaacgattcccaca

SEQ ID NO: 17281 - DNA, 31 bp, Artificial Sequence
  Description of Artificial Sequence:  Enzymatic Nucleic Acid
gagacccaggctagctacaacgactaaggag

SEQ ID NO: 17282 - DNA, 31 bp, Artificial Sequence
  Description of Artificial Sequence:  Enzymatic Nucleic Acid
tatggagaggctagctacaacgaccacctaa

SEQ ID NO: 17283 - DNA, 31 bp, Artificial Sequence
  Description of Artificial Sequence:  Enzymatic Nucleic Acid
cctgggtaggctagctacaacgaggagaccc

SEQ ID NO: 17284 - DNA, 31 bp, Artificial Sequence
  Description of Artificial Sequence:  Enzymatic Nucleic Acid
ctcctgggggctagctacaacgaatggagac

SEQ ID NO: 17285 - DNA, 31 bp, Artificial Sequence
  Description of Artificial Sequence:  Enzymatic Nucleic Acid
catttgtaggctagctacaacgatcctgggt

SEQ ID NO: 17286 - DNA, 31 bp, Artificial Sequence
  Description of Artificial Sequence:  Enzymatic Nucleic Acid
tccatttgggctagctacaacgaactcctgg

SEQ ID NO: 17287 - DNA, 31 bp, Artificial Sequence
  Description of Artificial Sequence:  Enzymatic Nucleic Acid
ctcatccaggctagctacaacgattgtactc

SEQ ID NO: 17288 - DNA, 31 bp, Artificial Sequence
  Description of Artificial Sequence:  Enzymatic Nucleic Acid
agtcctcaggctagctacaacgaccatttgt

SEQ ID NO: 17289 - DNA, 31 bp, Artificial Sequence
  Description of Artificial Sequence:  Enzymatic Nucleic Acid
tgcaaaagggctagctacaacgacctcatcc

SEQ ID NO: 17290 - DNA, 31 bp, Artificial Sequence
  Description of Artificial Sequence:  Enzymatic Nucleic Acid
ggcgactgggctagctacaacgaaaaagtcc

SEQ ID NO: 17291 - DNA, 31 bp, Artificial Sequence
  Description of Artificial Sequence:  Enzymatic Nucleic Acid
tcaggcgaggctagctacaacgatgcaaaag

SEQ ID NO: 17292 - DNA, 31 bp, Artificial Sequence
  Description of Artificial Sequence:  Enzymatic Nucleic Acid
ccctcaggggctagctacaacgagactgcaa

SEQ ID NO: 17293 - DNA, 31 bp, Artificial Sequence
  Description of Artificial Sequence:  Enzymatic Nucleic Acid
tcctcatgggctagctacaacgacttccctc

SEQ ID NO: 17294 - DNA, 31 bp, Artificial Sequence
  Description of Artificial Sequence:  Enzymatic Nucleic Acid
catcctcaggctagctacaacgagccttccc

SEQ ID NO: 17295 - DNA, 31 bp, Artificial Sequence
  Description of Artificial Sequence:  Enzymatic Nucleic Acid
agctctcaggctagctacaacgacctcatgc

SEQ ID NO: 17296 - DNA, 31 bp, Artificial Sequence
  Description of Artificial Sequence:  Enzymatic Nucleic Acid
ctcaggagggctagctacaacgatctcatcc

SEQ ID NO: 17297 - DNA, 31 bp, Artificial Sequence
  Description of Artificial Sequence:  Enzymatic Nucleic Acid
gtagagtaggctagctacaacgatcaggagc

SEQ ID NO: 17298 - DNA, 31 bp, Artificial Sequence
  Description of Artificial Sequence:  Enzymatic Nucleic Acid
gagtagagggctagctacaacgaactcagga

SEQ ID NO: 17299 - DNA, 31 bp, Artificial Sequence
  Description of Artificial Sequence:  Enzymatic Nucleic Acid
ttcaggagggctagctacaacgaagagtact

SEQ ID NO: 17300 - DNA, 31 bp, Artificial Sequence
  Description of Artificial Sequence:  Enzymatic Nucleic Acid
ctgatagaggctagctacaacgattcaggag

SEQ ID NO: 17301 - DNA, 31 bp, Artificial Sequence
  Description of Artificial Sequence:  Enzymatic Nucleic Acid
tgatctgaggctagctacaacgaagatttca

SEQ ID NO: 17302 - DNA, 31 bp, Artificial Sequence
  Description of Artificial Sequence:  Enzymatic Nucleic Acid
cagcatgaggctagctacaacgactgataga

SEQ ID NO: 17303 - DNA, 31 bp, Artificial Sequence
  Description of Artificial Sequence:  Enzymatic Nucleic Acid
gtccagcaggctagctacaacgagatctgat

SEQ ID NO: 17304 - DNA, 31 bp, Artificial Sequence
  Description of Artificial Sequence:  Enzymatic Nucleic Acid
cagtccagggctagctacaacgaatgatctg

SEQ ID NO: 17305 - DNA, 31 bp, Artificial Sequence
  Description of Artificial Sequence:  Enzymatic Nucleic Acid
gccagcagggctagctacaacgaccagcatg

SEQ ID NO: 17306 - DNA, 31 bp, Artificial Sequence
  Description of Artificial Sequence:  Enzymatic Nucleic Acid
tgtgccagggctagctacaacgaagtccagc

SEQ ID NO: 17307 - DNA, 31 bp, Artificial Sequence
  Description of Artificial Sequence:  Enzymatic Nucleic Acid
tctctgtgggctagctacaacgacagcagtc

SEQ ID NO: 17308 - DNA, 31 bp, Artificial Sequence
  Description of Artificial Sequence:  Enzymatic Nucleic Acid
ggtctctgggctagctacaacgagccagcag

SEQ ID NO: 17309 - DNA, 31 bp, Artificial Sequence
  Description of Artificial Sequence:  Enzymatic Nucleic Acid
cttttgggggctagctacaacgactctgtgc

SEQ ID NO: 17310 - DNA, 31 bp, Artificial Sequence
  Description of Artificial Sequence:  Enzymatic Nucleic Acid
aatcttggggctagctacaacgactttcttt

SEQ ID NO: 17311 - DNA, 31 bp, Artificial Sequence
  Description of Artificial Sequence:  Enzymatic Nucleic Acid
tctgcaaaggctagctacaacgacttggcct

SEQ ID NO: 17312 - DNA, 31 bp, Artificial Sequence
  Description of Artificial Sequence:  Enzymatic Nucleic Acid
aagttctgggctagctacaacgaaaatcttg

SEQ ID NO: 17313 - DNA, 31 bp, Artificial Sequence
  Description of Artificial Sequence:  Enzymatic Nucleic Acid
tccacaagggctagctacaacgatctgcaaa

SEQ ID NO: 17314 - DNA, 31 bp, Artificial Sequence
  Description of Artificial Sequence:  Enzymatic Nucleic Acid
tttttccaggctagctacaacgaaagttctg

SEQ ID NO: 17315 - DNA, 31 bp, Artificial Sequence
  Description of Artificial Sequence:  Enzymatic Nucleic Acid
tcacctagggctagctacaacgattttccac

SEQ ID NO: 17316 - DNA, 31 bp, Artificial Sequence
  Description of Artificial Sequence:  Enzymatic Nucleic Acid
gcaaatcaggctagctacaacgactagtttt

SEQ ID NO: 17317 - DNA, 31 bp, Artificial Sequence
  Description of Artificial Sequence:  Enzymatic Nucleic Acid
gaagcaaaggctagctacaacgacacctagt

SEQ ID NO: 17318 - DNA, 31 bp, Artificial Sequence
  Description of Artificial Sequence:  Enzymatic Nucleic Acid
gcttgaagggctagctacaacgaaaatcacc

SEQ ID NO: 17319 - DNA, 31 bp, Artificial Sequence
  Description of Artificial Sequence:  Enzymatic Nucleic Acid
tacatttgggctagctacaacgattgaagca

SEQ ID NO: 17320 - DNA, 31 bp, Artificial Sequence
  Description of Artificial Sequence:  Enzymatic Nucleic Acid
gttgtacaggctagctacaacgattgcttga

SEQ ID NO: 17321 - DNA, 31 bp, Artificial Sequence
  Description of Artificial Sequence:  Enzymatic Nucleic Acid
ctgttgtaggctagctacaacgaatttgctt

SEQ ID NO: 17322 - DNA, 31 bp, Artificial Sequence
  Description of Artificial Sequence:  Enzymatic Nucleic Acid
tcctgttgggctagctacaacgaacatttgc

SEQ ID NO: 17323 - DNA, 31 bp, Artificial Sequence
  Description of Artificial Sequence:  Enzymatic Nucleic Acid
ccatcctgggctagctacaacgatgtacatt

SEQ ID NO: 17324 - DNA, 31 bp, Artificial Sequence
  Description of Artificial Sequence:  Enzymatic Nucleic Acid
ctttaccaggctagctacaacgacctgttgt

SEQ ID NO: 17325 - DNA, 31 bp, Artificial Sequence
  Description of Artificial Sequence:  Enzymatic Nucleic Acid
agtctttaggctagctacaacgacatcctgt

SEQ ID NO: 17326 - DNA, 31 bp, Artificial Sequence
  Description of Artificial Sequence:  Enzymatic Nucleic Acid
ggatgtagggctagctacaacgactttacca

SEQ ID NO: 17327 - DNA, 31 bp, Artificial Sequence
  Description of Artificial Sequence:  Enzymatic Nucleic Acid
ttgggatgggctagctacaacgaagtcttta

SEQ ID NO: 17328 - DNA, 31 bp, Artificial Sequence
  Description of Artificial Sequence:  Enzymatic Nucleic Acid
gattgggaggctagctacaacgagtagtctt

SEQ ID NO: 17329 - DNA, 31 bp, Artificial Sequence
  Description of Artificial Sequence:  Enzymatic Nucleic Acid
ggcattgaggctagctacaacgatgggatgt

SEQ ID NO: 17330 - DNA, 31 bp, Artificial Sequence
  Description of Artificial Sequence:  Enzymatic Nucleic Acid
gtatggcaggctagctacaacgatgattggg

SEQ ID NO: 17331 - DNA, 31 bp, Artificial Sequence
  Description of Artificial Sequence:  Enzymatic Nucleic Acid
cagtatggggctagctacaacgaattgattg

SEQ ID NO: 17332 - DNA, 31 bp, Artificial Sequence
  Description of Artificial Sequence:  Enzymatic Nucleic Acid
tgtcagtaggctagctacaacgaggcattga

SEQ ID NO: 17333 - DNA, 31 bp, Artificial Sequence
  Description of Artificial Sequence:  Enzymatic Nucleic Acid
cctgtcagggctagctacaacgaatggcatt

SEQ ID NO: 17334 - DNA, 31 bp, Artificial Sequence
  Description of Artificial Sequence:  Enzymatic Nucleic Acid
atttcctgggctagctacaacgacagtatgg

SEQ ID NO: 17335 - DNA, 31 bp, Artificial Sequence
  Description of Artificial Sequence:  Enzymatic Nucleic Acid
acccactaggctagctacaacgattcctgtc

SEQ ID NO: 17336 - DNA, 31 bp, Artificial Sequence
  Description of Artificial Sequence:  Enzymatic Nucleic Acid
taaacccaggctagctacaacgatatttcct

SEQ ID NO: 17337 - DNA, 31 bp, Artificial Sequence
  Description of Artificial Sequence:  Enzymatic Nucleic Acid
tatgtaaaggctagctacaacgaccactatt

SEQ ID NO: 17338 - DNA, 31 bp, Artificial Sequence
  Description of Artificial Sequence:  Enzymatic Nucleic Acid
tgagtatgggctagctacaacgaaaacccac

SEQ ID NO: 17339 - DNA, 31 bp, Artificial Sequence
  Description of Artificial Sequence:  Enzymatic Nucleic Acid
gttgagtaggctagctacaacgagtaaaccc

SEQ ID NO: 17340 - DNA, 31 bp, Artificial Sequence
  Description of Artificial Sequence:  Enzymatic Nucleic Acid
gagttgagggctagctacaacgaatgtaaac

SEQ ID NO: 17341 - DNA, 31 bp, Artificial Sequence
  Description of Artificial Sequence:  Enzymatic Nucleic Acid
ggcaggagggctagctacaacgatgagtatg

SEQ ID NO: 17342 - DNA, 31 bp, Artificial Sequence
  Description of Artificial Sequence:  Enzymatic Nucleic Acid
agagaaggggctagctacaacgaaggagttg

SEQ ID NO: 17343 - DNA, 31 bp, Artificial Sequence
  Description of Artificial Sequence:  Enzymatic Nucleic Acid
tgaagaagggctagctacaacgacctcagag

SEQ ID NO: 17344 - DNA, 31 bp, Artificial Sequence
  Description of Artificial Sequence:  Enzymatic Nucleic Acid
ctgaaataggctagctacaacgatttccttg

SEQ ID NO: 17345 - DNA, 31 bp, Artificial Sequence
  Description of Artificial Sequence:  Enzymatic Nucleic Acid
agctgaaaggctagctacaacgaactttcct

SEQ ID NO: 17346 - DNA, 31 bp, Artificial Sequence
  Description of Artificial Sequence:  Enzymatic Nucleic Acid
cttcggagggctagctacaacgatgaaatac

SEQ ID NO: 17347 - DNA, 31 bp, Artificial Sequence
  Description of Artificial Sequence:  Enzymatic Nucleic Acid
gaattaaaggctagctacaacgattcggagc

SEQ ID NO: 17348 - DNA, 31 bp, Artificial Sequence
  Description of Artificial Sequence:  Enzymatic Nucleic Acid
ttcctgaaggctagctacaacgataaacttc

SEQ ID NO: 17349 - DNA, 31 bp, Artificial Sequence
  Description of Artificial Sequence:  Enzymatic Nucleic Acid
catcagagggctagctacaacgattcctgaa

SEQ ID NO: 17350 - DNA, 31 bp, Artificial Sequence
  Description of Artificial Sequence:  Enzymatic Nucleic Acid
tgacatcaggctagctacaacgacagagctt

SEQ ID NO: 17351 - DNA, 31 bp, Artificial Sequence
  Description of Artificial Sequence:  Enzymatic Nucleic Acid
atctgacaggctagctacaacgacatcagag

SEQ ID NO: 17352 - DNA, 31 bp, Artificial Sequence
  Description of Artificial Sequence:  Enzymatic Nucleic Acid
atatctgaggctagctacaacgaatcatcag

SEQ ID NO: 17353 - DNA, 31 bp, Artificial Sequence
  Description of Artificial Sequence:  Enzymatic Nucleic Acid
tttacataggctagctacaacgactgacatc

SEQ ID NO: 17354 - DNA, 31 bp, Artificial Sequence
  Description of Artificial Sequence:  Enzymatic Nucleic Acid
catttacaggctagctacaacgaatctgaca

SEQ ID NO: 17355 - DNA, 31 bp, Artificial Sequence
  Description of Artificial Sequence:  Enzymatic Nucleic Acid
agcatttaggctagctacaacgaatatctga

SEQ ID NO: 17356 - DNA, 31 bp, Artificial Sequence
  Description of Artificial Sequence:  Enzymatic Nucleic Acid
tgaaagcaggctagctacaacgattacatat

SEQ ID NO: 17357 - DNA, 31 bp, Artificial Sequence
  Description of Artificial Sequence:  Enzymatic Nucleic Acid
cttgaaagggctagctacaacgaatttacat

SEQ ID NO: 17358 - DNA, 31 bp, Artificial Sequence
  Description of Artificial Sequence:  Enzymatic Nucleic Acid
ctcatgaaggctagctacaacgattgaaagc

SEQ ID NO: 17359 - DNA, 31 bp, Artificial Sequence
  Description of Artificial Sequence:  Enzymatic Nucleic Acid
caggctcaggctagctacaacgagaacttga

SEQ ID NO: 17360 - DNA, 31 bp, Artificial Sequence
  Description of Artificial Sequence:  Enzymatic Nucleic Acid
tttccaggggctagctacaacgatcatgaac

SEQ ID NO: 17361 - DNA, 31 bp, Artificial Sequence
  Description of Artificial Sequence:  Enzymatic Nucleic Acid
ggttttgaggctagctacaacgatctttcca

SEQ ID NO: 17362 - DNA, 31 bp, Artificial Sequence
  Description of Artificial Sequence:  Enzymatic Nucleic Acid
ttcaaaggggctagctacaacgatttgattc

SEQ ID NO: 17363 - DNA, 31 bp, Artificial Sequence
  Description of Artificial Sequence:  Enzymatic Nucleic Acid
ggtaaaagggctagctacaacgatcttcaaa

SEQ ID NO: 17364 - DNA, 31 bp, Artificial Sequence
  Description of Artificial Sequence:  Enzymatic Nucleic Acid
gcattcggggctagctacaacgaaaaagttc

SEQ ID NO: 17365 - DNA, 31 bp, Artificial Sequence
  Description of Artificial Sequence:  Enzymatic Nucleic Acid
aggtggcaggctagctacaacgatcggtaaa

SEQ ID NO: 17366 - DNA, 31 bp, Artificial Sequence
  Description of Artificial Sequence:  Enzymatic Nucleic Acid
ggaggtggggctagctacaacgaattcggta

SEQ ID NO: 17367 - DNA, 31 bp, Artificial Sequence
  Description of Artificial Sequence:  Enzymatic Nucleic Acid
catggaggggctagctacaacgaggcattcg

SEQ ID NO: 17368 - DNA, 31 bp, Artificial Sequence
  Description of Artificial Sequence:  Enzymatic Nucleic Acid
atcaaacaggctagctacaacgaggaggtgg

SEQ ID NO: 17369 - DNA, 31 bp, Artificial Sequence
  Description of Artificial Sequence:  Enzymatic Nucleic Acid
tcatcaaaggctagctacaacgaatggaggt

SEQ ID NO: 17370 - DNA, 31 bp, Artificial Sequence
  Description of Artificial Sequence:  Enzymatic Nucleic Acid
ggtagtcaggctagctacaacgacaaacatg

SEQ ID NO: 17371 - DNA, 31 bp, Artificial Sequence
  Description of Artificial Sequence:  Enzymatic Nucleic Acid
cctggtagggctagctacaacgacatcaaac

SEQ ID NO: 17372 - DNA, 31 bp, Artificial Sequence
  Description of Artificial Sequence:  Enzymatic Nucleic Acid
cgccctggggctagctacaacgaagtcatca

SEQ ID NO: 17373 - DNA, 31 bp, Artificial Sequence
  Description of Artificial Sequence:  Enzymatic Nucleic Acid
tgctgtcgggctagctacaacgacctggtag

SEQ ID NO: 17374 - DNA, 31 bp, Artificial Sequence
  Description of Artificial Sequence:  Enzymatic Nucleic Acid
tgctgctgggctagctacaacgacgccctgg

SEQ ID NO: 17375 - DNA, 31 bp, Artificial Sequence
  Description of Artificial Sequence:  Enzymatic Nucleic Acid
gagtgctgggctagctacaacgatgtcgccc

SEQ ID NO: 17376 - DNA, 31 bp, Artificial Sequence
  Description of Artificial Sequence:  Enzymatic Nucleic Acid
acagagtgggctagctacaacgatgctgtcg

SEQ ID NO: 17377 - DNA, 31 bp, Artificial Sequence
  Description of Artificial Sequence:  Enzymatic Nucleic Acid
caacagagggctagctacaacgagctgctgt

SEQ ID NO: 17378 - DNA, 31 bp, Artificial Sequence
  Description of Artificial Sequence:  Enzymatic Nucleic Acid
gaggccaaggctagctacaacgaagagtgct

SEQ ID NO: 17379 - DNA, 31 bp, Artificial Sequence
  Description of Artificial Sequence:  Enzymatic Nucleic Acid
gggagaggggctagctacaacgacaacagag

SEQ ID NO: 17380 - DNA, 31 bp, Artificial Sequence
  Description of Artificial Sequence:  Enzymatic Nucleic Acid
cttcagcaggctagctacaacgagggagagg

SEQ ID NO: 17381 - DNA, 31 bp, Artificial Sequence
  Description of Artificial Sequence:  Enzymatic Nucleic Acid
cgcttcagggctagctacaacgaatgggaga

SEQ ID NO: 17382 - DNA, 31 bp, Artificial Sequence
  Description of Artificial Sequence:  Enzymatic Nucleic Acid
gtgaagcgggctagctacaacgattcagcat

SEQ ID NO: 17383 - DNA, 31 bp, Artificial Sequence
  Description of Artificial Sequence:  Enzymatic Nucleic Acid
aggtgaagggctagctacaacgagcttcagc

SEQ ID NO: 17384 - DNA, 31 bp, Artificial Sequence
  Description of Artificial Sequence:  Enzymatic Nucleic Acid
agtccaggggctagctacaacgagaagcgct

SEQ ID NO: 17385 - DNA, 31 bp, Artificial Sequence
  Description of Artificial Sequence:  Enzymatic Nucleic Acid
gctgtcagggctagctacaacgaccaggtga

SEQ ID NO: 17386 - DNA, 31 bp, Artificial Sequence
  Description of Artificial Sequence:  Enzymatic Nucleic Acid
gtttgctgggctagctacaacgacagtccag

SEQ ID NO: 17387 - DNA, 31 bp, Artificial Sequence
  Description of Artificial Sequence:  Enzymatic Nucleic Acid
tgggtttgggctagctacaacgatgtcagtc

SEQ ID NO: 17388 - DNA, 31 bp, Artificial Sequence
  Description of Artificial Sequence:  Enzymatic Nucleic Acid
gccttgggggctagctacaacgattgctgtc

SEQ ID NO: 17389 - DNA, 31 bp, Artificial Sequence
  Description of Artificial Sequence:  Enzymatic Nucleic Acid
gagcgaggggctagctacaacgacttgggtt

SEQ ID NO: 17390 - DNA, 31 bp, Artificial Sequence
  Description of Artificial Sequence:  Enzymatic Nucleic Acid
atcttgagggctagctacaacgagaggcctt

SEQ ID NO: 17391 - DNA, 31 bp, Artificial Sequence
  Description of Artificial Sequence:  Enzymatic Nucleic Acid
caagtcaaggctagctacaacgacttgagcg

SEQ ID NO: 17392 - DNA, 31 bp, Artificial Sequence
  Description of Artificial Sequence:  Enzymatic Nucleic Acid
ctctcaagggctagctacaacgacaatcttg

SEQ ID NO: 17393 - DNA, 31 bp, Artificial Sequence
  Description of Artificial Sequence:  Enzymatic Nucleic Acid
actggttaggctagctacaacgatctcaagt

SEQ ID NO: 17394 - DNA, 31 bp, Artificial Sequence
  Description of Artificial Sequence:  Enzymatic Nucleic Acid
tttactggggctagctacaacgatactctca

SEQ ID NO: 17395 - DNA, 31 bp, Artificial Sequence
  Description of Artificial Sequence:  Enzymatic Nucleic Acid
tacttttaggctagctacaacgatggttact

SEQ ID NO: 17396 - DNA, 31 bp, Artificial Sequence
  Description of Artificial Sequence:  Enzymatic Nucleic Acid
actccttaggctagctacaacgattttactg

SEQ ID NO: 17397 - DNA, 31 bp, Artificial Sequence
  Description of Artificial Sequence:  Enzymatic Nucleic Acid
agccccgaggctagctacaacgatccttact

SEQ ID NO: 17398 - DNA, 31 bp, Artificial Sequence
  Description of Artificial Sequence:  Enzymatic Nucleic Acid
tcagacagggctagctacaacgacccgactc

SEQ ID NO: 17399 - DNA, 31 bp, Artificial Sequence
  Description of Artificial Sequence:  Enzymatic Nucleic Acid
acatcagaggctagctacaacgaagccccga

SEQ ID NO: 17400 - DNA, 31 bp, Artificial Sequence
  Description of Artificial Sequence:  Enzymatic Nucleic Acid
tgctgacaggctagctacaacgacagacagc

SEQ ID NO: 17401 - DNA, 31 bp, Artificial Sequence
  Description of Artificial Sequence:  Enzymatic Nucleic Acid
cctgctgaggctagctacaacgaatcagaca

SEQ ID NO: 17402 - DNA, 31 bp, Artificial Sequence
  Description of Artificial Sequence:  Enzymatic Nucleic Acid
tgggcctgggctagctacaacgatgacatca

SEQ ID NO: 17403 - DNA, 31 bp, Artificial Sequence
  Description of Artificial Sequence:  Enzymatic Nucleic Acid
aaactgggggctagctacaacgactgctgac

SEQ ID NO: 17404 - DNA, 31 bp, Artificial Sequence
  Description of Artificial Sequence:  Enzymatic Nucleic Acid
ggcagaaaggctagctacaacgatgggcctg

SEQ ID NO: 17405 - DNA, 31 bp, Artificial Sequence
  Description of Artificial Sequence:  Enzymatic Nucleic Acid
tggaatggggctagctacaacgaagaaactg

SEQ ID NO: 17406 - DNA, 31 bp, Artificial Sequence
  Description of Artificial Sequence:  Enzymatic Nucleic Acid
agctggaaggctagctacaacgaggcagaaa

SEQ ID NO: 17407 - DNA, 31 bp, Artificial Sequence
  Description of Artificial Sequence:  Enzymatic Nucleic Acid
gcccacagggctagctacaacgatggaatgg

SEQ ID NO: 17408 - DNA, 31 bp, Artificial Sequence
  Description of Artificial Sequence:  Enzymatic Nucleic Acid
cgtgcccaggctagctacaacgaagctggaa

SEQ ID NO: 17409 - DNA, 31 bp, Artificial Sequence
  Description of Artificial Sequence:  Enzymatic Nucleic Acid
ctgacgtgggctagctacaacgaccacagct

SEQ ID NO: 17410 - DNA, 31 bp, Artificial Sequence
  Description of Artificial Sequence:  Enzymatic Nucleic Acid
cgctgacgggctagctacaacgagcccacag

SEQ ID NO: 17411 - DNA, 31 bp, Artificial Sequence
  Description of Artificial Sequence:  Enzymatic Nucleic Acid
ttcgctgaggctagctacaacgagtgcccac

SEQ ID NO: 17412 - DNA, 31 bp, Artificial Sequence
  Description of Artificial Sequence:  Enzymatic Nucleic Acid
tgccttcgggctagctacaacgatgacgtgc

SEQ ID NO: 17413 - DNA, 31 bp, Artificial Sequence
  Description of Artificial Sequence:  Enzymatic Nucleic Acid
tgcgcttgggctagctacaacgacttcgctg

SEQ ID NO: 17414 - DNA, 31 bp, Artificial Sequence
  Description of Artificial Sequence:  Enzymatic Nucleic Acid
aacctgcgggctagctacaacgattgccttc

SEQ ID NO: 17415 - DNA, 31 bp, Artificial Sequence
  Description of Artificial Sequence:  Enzymatic Nucleic Acid
tgaacctgggctagctacaacgagcttgcct

SEQ ID NO: 17416 - DNA, 31 bp, Artificial Sequence
  Description of Artificial Sequence:  Enzymatic Nucleic Acid
taggtgaaggctagctacaacgactgcgctt

SEQ ID NO: 17417 - DNA, 31 bp, Artificial Sequence
  Description of Artificial Sequence:  Enzymatic Nucleic Acid
gtcgtaggggctagctacaacgagaacctgc

SEQ ID NO: 17418 - DNA, 31 bp, Artificial Sequence
  Description of Artificial Sequence:  Enzymatic Nucleic Acid
cgtggtcgggctagctacaacgaaggtgaac

SEQ ID NO: 17419 - DNA, 31 bp, Artificial Sequence
  Description of Artificial Sequence:  Enzymatic Nucleic Acid
cagcgtggggctagctacaacgacgtaggtg

SEQ ID NO: 17420 - DNA, 31 bp, Artificial Sequence
  Description of Artificial Sequence:  Enzymatic Nucleic Acid
gctcagcgggctagctacaacgaggtcgtag

SEQ ID NO: 17421 - DNA, 31 bp, Artificial Sequence
  Description of Artificial Sequence:  Enzymatic Nucleic Acid
cagctcagggctagctacaacgagtggtcgt

SEQ ID NO: 17422 - DNA, 31 bp, Artificial Sequence
  Description of Artificial Sequence:  Enzymatic Nucleic Acid
ctttccagggctagctacaacgatcagcgtg

SEQ ID NO: 17423 - DNA, 31 bp, Artificial Sequence
  Description of Artificial Sequence:  Enzymatic Nucleic Acid
gcacgcgaggctagctacaacgatttccttt

SEQ ID NO: 17424 - DNA, 31 bp, Artificial Sequence
  Description of Artificial Sequence:  Enzymatic Nucleic Acid
gcagcacgggctagctacaacgagattttcc

SEQ ID NO: 17425 - DNA, 31 bp, Artificial Sequence
  Description of Artificial Sequence:  Enzymatic Nucleic Acid
gagcagcaggctagctacaacgagcgatttt

SEQ ID NO: 17426 - DNA, 31 bp, Artificial Sequence
  Description of Artificial Sequence:  Enzymatic Nucleic Acid
gggagcagggctagctacaacgaacgcgatt

SEQ ID NO: 17427 - DNA, 31 bp, Artificial Sequence
  Description of Artificial Sequence:  Enzymatic Nucleic Acid
gcggggagggctagctacaacgaagcacgcg

SEQ ID NO: 17428 - DNA, 31 bp, Artificial Sequence
  Description of Artificial Sequence:  Enzymatic Nucleic Acid
tctgggggggctagctacaacgaggggagca

SEQ ID NO: 17429 - DNA, 31 bp, Artificial Sequence
  Description of Artificial Sequence:  Enzymatic Nucleic Acid
agttgtagggctagctacaacgactgggggc

SEQ ID NO: 17430 - DNA, 31 bp, Artificial Sequence
  Description of Artificial Sequence:  Enzymatic Nucleic Acid
ccgagttgggctagctacaacgaagtctggg

SEQ ID NO: 17431 - DNA, 31 bp, Artificial Sequence
  Description of Artificial Sequence:  Enzymatic Nucleic Acid
ccaccgagggctagctacaacgatgtagtct

SEQ ID NO: 17432 - DNA, 31 bp, Artificial Sequence
  Description of Artificial Sequence:  Enzymatic Nucleic Acid
caggaccaggctagctacaacgacgagttgt

SEQ ID NO: 17433 - DNA, 31 bp, Artificial Sequence
  Description of Artificial Sequence:  Enzymatic Nucleic Acid
gtacaggaggctagctacaacgacaccgagt

SEQ ID NO: 17434 - DNA, 31 bp, Artificial Sequence
  Description of Artificial Sequence:  Enzymatic Nucleic Acid
gtggagtaggctagctacaacgaaggaccac

SEQ ID NO: 17435 - DNA, 31 bp, Artificial Sequence
  Description of Artificial Sequence:  Enzymatic Nucleic Acid
gggtggagggctagctacaacgaacaggacc

SEQ ID NO: 17436 - DNA, 31 bp, Artificial Sequence
  Description of Artificial Sequence:  Enzymatic Nucleic Acid
gggtggggggctagctacaacgaggagtaca

SEQ ID NO: 17437 - DNA, 31 bp, Artificial Sequence
  Description of Artificial Sequence:  Enzymatic Nucleic Acid
tagatgggggctagctacaacgaggggtgga

SEQ ID NO: 17438 - DNA, 31 bp, Artificial Sequence
  Description of Artificial Sequence:  Enzymatic Nucleic Acid
actctagaggctagctacaacgagggtgggg

SEQ ID NO: 17439 - DNA, 31 bp, Artificial Sequence
  Description of Artificial Sequence:  Enzymatic Nucleic Acid
gtgtcaaaggctagctacaacgatctagatg

SEQ ID NO: 17440 - DNA, 31 bp, Artificial Sequence
  Description of Artificial Sequence:  Enzymatic Nucleic Acid
gcttcgtgggctagctacaacgacaaactct

SEQ ID NO: 17441 - DNA, 31 bp, Artificial Sequence
  Description of Artificial Sequence:  Enzymatic Nucleic Acid
aggcttcgggctagctacaacgagtcaaact

SEQ ID NO: 17442 - DNA, 31 bp, Artificial Sequence
  Description of Artificial Sequence:  Enzymatic Nucleic Acid
aaataaggggctagctacaacgattcgtgtc

SEQ ID NO: 17443 - DNA, 31 bp, Artificial Sequence
  Description of Artificial Sequence:  Enzymatic Nucleic Acid
tctagaaaggctagctacaacgaaaggcttc

SEQ ID NO: 17444 - DNA, 31 bp, Artificial Sequence
  Description of Artificial Sequence:  Enzymatic Nucleic Acid
cacatgtgggctagctacaacgattctagaa

SEQ ID NO: 17445 - DNA, 31 bp, Artificial Sequence
  Description of Artificial Sequence:  Enzymatic Nucleic Acid
tacacatgggctagctacaacgagcttctag

SEQ ID NO: 17446 - DNA, 31 bp, Artificial Sequence
  Description of Artificial Sequence:  Enzymatic Nucleic Acid
aatacacaggctagctacaacgagtgcttct

SEQ ID NO: 17447 - DNA, 31 bp, Artificial Sequence
  Description of Artificial Sequence:  Enzymatic Nucleic Acid
taaatacaggctagctacaacgaatgtgctt

SEQ ID NO: 17448 - DNA, 31 bp, Artificial Sequence
  Description of Artificial Sequence:  Enzymatic Nucleic Acid
tataaataggctagctacaacgaacatgtgc

SEQ ID NO: 17449 - DNA, 31 bp, Artificial Sequence
  Description of Artificial Sequence:  Enzymatic Nucleic Acid
ggtataaaggctagctacaacgaacacatgt

SEQ ID NO: 17450 - DNA, 31 bp, Artificial Sequence
  Description of Artificial Sequence:  Enzymatic Nucleic Acid
tgggggtaggctagctacaacgaaaatacac

SEQ ID NO: 17451 - DNA, 31 bp, Artificial Sequence
  Description of Artificial Sequence:  Enzymatic Nucleic Acid
cctgggggggctagctacaacgaataaatac

SEQ ID NO: 17452 - DNA, 31 bp, Artificial Sequence
  Description of Artificial Sequence:  Enzymatic Nucleic Acid
aaagctagggctagctacaacgattcctggg

SEQ ID NO: 17453 - DNA, 31 bp, Artificial Sequence
  Description of Artificial Sequence:  Enzymatic Nucleic Acid
ggcaaaagggctagctacaacgatagtttcc

SEQ ID NO: 17454 - DNA, 31 bp, Artificial Sequence
  Description of Artificial Sequence:  Enzymatic Nucleic Acid
aatactggggctagctacaacgaaaaagcta

SEQ ID NO: 17455 - DNA, 31 bp, Artificial Sequence
  Description of Artificial Sequence:  Enzymatic Nucleic Acid
gcataataggctagctacaacgatggcaaaa

SEQ ID NO: 17456 - DNA, 31 bp, Artificial Sequence
  Description of Artificial Sequence:  Enzymatic Nucleic Acid
atgcataaggctagctacaacgaactggcaa

SEQ ID NO: 17457 - DNA, 31 bp, Artificial Sequence
  Description of Artificial Sequence:  Enzymatic Nucleic Acid
tatatgcaggctagctacaacgaaatactgg

SEQ ID NO: 17458 - DNA, 31 bp, Artificial Sequence
  Description of Artificial Sequence:  Enzymatic Nucleic Acid
tatatatgggctagctacaacgaataatact

SEQ ID NO: 17459 - DNA, 31 bp, Artificial Sequence
  Description of Artificial Sequence:  Enzymatic Nucleic Acid
cttatataggctagctacaacgagcataata

SEQ ID NO: 17460 - DNA, 31 bp, Artificial Sequence
  Description of Artificial Sequence:  Enzymatic Nucleic Acid
aacttataggctagctacaacgaatgcataa

SEQ ID NO: 17461 - DNA, 31 bp, Artificial Sequence
  Description of Artificial Sequence:  Enzymatic Nucleic Acid
taaacttaggctagctacaacgaatatgcat

SEQ ID NO: 17462 - DNA, 31 bp, Artificial Sequence
  Description of Artificial Sequence:  Enzymatic Nucleic Acid
ggtgtaaaggctagctacaacgattatatat

SEQ ID NO: 17463 - DNA, 31 bp, Artificial Sequence
  Description of Artificial Sequence:  Enzymatic Nucleic Acid
taaaggtgggctagctacaacgaaaacttat

SEQ ID NO: 17464 - DNA, 31 bp, Artificial Sequence
  Description of Artificial Sequence:  Enzymatic Nucleic Acid
gataaaggggctagctacaacgagtaaactt

SEQ ID NO: 17465 - DNA, 31 bp, Artificial Sequence
  Description of Artificial Sequence:  Enzymatic Nucleic Acid
tggaaagaggctagctacaacgaaaaggtgt

SEQ ID NO: 17466 - DNA, 31 bp, Artificial Sequence
  Description of Artificial Sequence:  Enzymatic Nucleic Acid
ggctcccaggctagctacaacgaggaaagat

SEQ ID NO: 17467 - DNA, 31 bp, Artificial Sequence
  Description of Artificial Sequence:  Enzymatic Nucleic Acid
gcagctggggctagctacaacgatcccatgg

SEQ ID NO: 17468 - DNA, 31 bp, Artificial Sequence
  Description of Artificial Sequence:  Enzymatic Nucleic Acid
aaaagcagggctagctacaacgatggctccc

SEQ ID NO: 17469 - DNA, 31 bp, Artificial Sequence
  Description of Artificial Sequence:  Enzymatic Nucleic Acid
acaaaaagggctagctacaacgaagctggct

SEQ ID NO: 17470 - DNA, 31 bp, Artificial Sequence
  Description of Artificial Sequence:  Enzymatic Nucleic Acid
aaaaatcaggctagctacaacgaaaaaagca

SEQ ID NO: 17471 - DNA, 31 bp, Artificial Sequence
  Description of Artificial Sequence:  Enzymatic Nucleic Acid
taaaaaaaggctagctacaacgacacaaaaa

SEQ ID NO: 17472 - DNA, 31 bp, Artificial Sequence
  Description of Artificial Sequence:  Enzymatic Nucleic Acid
aagcactaggctagctacaacgataaaaaaa

SEQ ID NO: 17473 - DNA, 31 bp, Artificial Sequence
  Description of Artificial Sequence:  Enzymatic Nucleic Acid
aaaaagcaggctagctacaacgatattaaaa

SEQ ID NO: 17474 - DNA, 31 bp, Artificial Sequence
  Description of Artificial Sequence:  Enzymatic Nucleic Acid
aaaaaaagggctagctacaacgaactattaa

SEQ ID NO: 17475 - DNA, 31 bp, Artificial Sequence
  Description of Artificial Sequence:  Enzymatic Nucleic Acid
cttgttagggctagctacaacgacaaaaaaa

SEQ ID NO: 17476 - DNA, 31 bp, Artificial Sequence
  Description of Artificial Sequence:  Enzymatic Nucleic Acid
cattcttgggctagctacaacgatagtcaaa

SEQ ID NO: 17477 - DNA, 31 bp, Artificial Sequence
  Description of Artificial Sequence:  Enzymatic Nucleic Acid
gagttacaggctagctacaacgatcttgtta

SEQ ID NO: 17478 - DNA, 31 bp, Artificial Sequence
  Description of Artificial Sequence:  Enzymatic Nucleic Acid
tggagttaggctagctacaacgaattcttgt

SEQ ID NO: 17479 - DNA, 31 bp, Artificial Sequence
  Description of Artificial Sequence:  Enzymatic Nucleic Acid
atctggagggctagctacaacgatacattct

SEQ ID NO: 17480 - DNA, 31 bp, Artificial Sequence
  Description of Artificial Sequence:  Enzymatic Nucleic Acid
tttctctaggctagctacaacgactggagtt

SEQ ID NO: 17481 - DNA, 31 bp, Artificial Sequence
  Description of Artificial Sequence:  Enzymatic Nucleic Acid
tgtcactaggctagctacaacgattctctat

SEQ ID NO: 17482 - DNA, 31 bp, Artificial Sequence
  Description of Artificial Sequence:  Enzymatic Nucleic Acid
acttgtcaggctagctacaacgatatttctc

SEQ ID NO: 17483 - DNA, 31 bp, Artificial Sequence
  Description of Artificial Sequence:  Enzymatic Nucleic Acid
ttcacttgggctagctacaacgacactattt

SEQ ID NO: 17484 - DNA, 31 bp, Artificial Sequence
  Description of Artificial Sequence:  Enzymatic Nucleic Acid
gttcttcaggctagctacaacgattgtcact

SEQ ID NO: 17485 - DNA, 31 bp, Artificial Sequence
  Description of Artificial Sequence:  Enzymatic Nucleic Acid
cagtagtgggctagctacaacgatcttcact

SEQ ID NO: 17486 - DNA, 31 bp, Artificial Sequence
  Description of Artificial Sequence:  Enzymatic Nucleic Acid
agcagtagggctagctacaacgagttcttca

SEQ ID NO: 17487 - DNA, 31 bp, Artificial Sequence
  Description of Artificial Sequence:  Enzymatic Nucleic Acid
tttagcagggctagctacaacgaagtgttct

SEQ ID NO: 17488 - DNA, 31 bp, Artificial Sequence
  Description of Artificial Sequence:  Enzymatic Nucleic Acid
ggatttagggctagctacaacgaagtagtgt

SEQ ID NO: 17489 - DNA, 31 bp, Artificial Sequence
  Description of Artificial Sequence:  Enzymatic Nucleic Acid
catgaggaggctagctacaacgattagcagt

SEQ ID NO: 17490 - DNA, 31 bp, Artificial Sequence
  Description of Artificial Sequence:  Enzymatic Nucleic Acid
gagtaacaggctagctacaacgagaggattt

SEQ ID NO: 17491 - DNA, 31 bp, Artificial Sequence
  Description of Artificial Sequence:  Enzymatic Nucleic Acid
ctgagtaaggctagctacaacgaatgaggat

SEQ ID NO: 17492 - DNA, 31 bp, Artificial Sequence
  Description of Artificial Sequence:  Enzymatic Nucleic Acid
acactgagggctagctacaacgaaacatgag

SEQ ID NO: 17493 - DNA, 31 bp, Artificial Sequence
  Description of Artificial Sequence:  Enzymatic Nucleic Acid
ctctaacaggctagctacaacgatgagtaac

SEQ ID NO: 17494 - DNA, 31 bp, Artificial Sequence
  Description of Artificial Sequence:  Enzymatic Nucleic Acid
ttctctaaggctagctacaacgaactgagta

SEQ ID NO: 17495 - DNA, 31 bp, Artificial Sequence
  Description of Artificial Sequence:  Enzymatic Nucleic Acid
aggaaggaggctagctacaacgattctctaa

SEQ ID NO: 17496 - DNA, 31 bp, Artificial Sequence
  Description of Artificial Sequence:  Enzymatic Nucleic Acid
tcattgggggctagctacaacgattaggaag

SEQ ID NO: 17497 - DNA, 31 bp, Artificial Sequence
  Description of Artificial Sequence:  Enzymatic Nucleic Acid
ggaagtcaggctagctacaacgatgggttta

SEQ ID NO: 17498 - DNA, 31 bp, Artificial Sequence
  Description of Artificial Sequence:  Enzymatic Nucleic Acid
cagggaagggctagctacaacgacattgggt

SEQ ID NO: 17499 - DNA, 31 bp, Artificial Sequence
  Description of Artificial Sequence:  Enzymatic Nucleic Acid
ggttggagggctagctacaacgaagggaagt

SEQ ID NO: 17500 - DNA, 31 bp, Artificial Sequence
  Description of Artificial Sequence:  Enzymatic Nucleic Acid
ggcgggggggctagctacaacgatggagcag

SEQ ID NO: 17501 - DNA, 31 bp, Artificial Sequence
  Description of Artificial Sequence:  Enzymatic Nucleic Acid
tgaggtggggctagctacaacgagggggttg

SEQ ID NO: 17502 - DNA, 31 bp, Artificial Sequence
  Description of Artificial Sequence:  Enzymatic Nucleic Acid
ccctgaggggctagctacaacgaggcggggg

SEQ ID NO: 17503 - DNA, 31 bp, Artificial Sequence
  Description of Artificial Sequence:  Enzymatic Nucleic Acid
cctgcgtgggctagctacaacgacctgaggt

SEQ ID NO: 17504 - DNA, 31 bp, Artificial Sequence
  Description of Artificial Sequence:  Enzymatic Nucleic Acid
gtcctgcgggctagctacaacgagccctgag

SEQ ID NO: 17505 - DNA, 31 bp, Artificial Sequence
  Description of Artificial Sequence:  Enzymatic Nucleic Acid
tggtcctgggctagctacaacgagtgccctg

SEQ ID NO: 17506 - DNA, 31 bp, Artificial Sequence
  Description of Artificial Sequence:  Enzymatic Nucleic Acid
caaactggggctagctacaacgacctgcgtg

SEQ ID NO: 17507 - DNA, 31 bp, Artificial Sequence
  Description of Artificial Sequence:  Enzymatic Nucleic Acid
caatcaaaggctagctacaacgatggtcctg

SEQ ID NO: 17508 - DNA, 31 bp, Artificial Sequence
  Description of Artificial Sequence:  Enzymatic Nucleic Acid
ctcctcaaggctagctacaacgacaaactgg

SEQ ID NO: 17509 - DNA, 31 bp, Artificial Sequence
  Description of Artificial Sequence:  Enzymatic Nucleic Acid
cagtgcagggctagctacaacgatcctcaat

SEQ ID NO: 17510 - DNA, 31 bp, Artificial Sequence
  Description of Artificial Sequence:  Enzymatic Nucleic Acid
gatcagtgggctagctacaacgaagctcctc

SEQ ID NO: 17511 - DNA, 31 bp, Artificial Sequence
  Description of Artificial Sequence:  Enzymatic Nucleic Acid
gtgatcagggctagctacaacgagcagctcc

SEQ ID NO: 17512 - DNA, 31 bp, Artificial Sequence
  Description of Artificial Sequence:  Enzymatic Nucleic Acid
ttgggtgaggctagctacaacgacagtgcag

SEQ ID NO: 17513 - DNA, 31 bp, Artificial Sequence
  Description of Artificial Sequence:  Enzymatic Nucleic Acid
gcattgggggctagctacaacgagatcagtg

SEQ ID NO: 17514 - DNA, 31 bp, Artificial Sequence
  Description of Artificial Sequence:  Enzymatic Nucleic Acid
gtgatgcaggctagctacaacgatgggtgat

SEQ ID NO: 17515 - DNA, 31 bp, Artificial Sequence
  Description of Artificial Sequence:  Enzymatic Nucleic Acid
acgtgatgggctagctacaacgaattgggtg

SEQ ID NO: 17516 - DNA, 31 bp, Artificial Sequence
  Description of Artificial Sequence:  Enzymatic Nucleic Acid
gtacgtgaggctagctacaacgagcattggg

SEQ ID NO: 17517 - DNA, 31 bp, Artificial Sequence
  Description of Artificial Sequence:  Enzymatic Nucleic Acid
ggggtacgggctagctacaacgagatgcatt

SEQ ID NO: 17518 - DNA, 31 bp, Artificial Sequence
  Description of Artificial Sequence:  Enzymatic Nucleic Acid
gtggggtaggctagctacaacgagtgatgca

SEQ ID NO: 17519 - DNA, 31 bp, Artificial Sequence
  Description of Artificial Sequence:  Enzymatic Nucleic Acid
cagtggggggctagctacaacgaacgtgatg

SEQ ID NO: 17520 - DNA, 31 bp, Artificial Sequence
  Description of Artificial Sequence:  Enzymatic Nucleic Acid
tggcccagggctagctacaacgaggggtacg

SEQ ID NO: 17521 - DNA, 31 bp, Artificial Sequence
  Description of Artificial Sequence:  Enzymatic Nucleic Acid
agggctggggctagctacaacgaccagtggg

SEQ ID NO: 17522 - DNA, 31 bp, Artificial Sequence
  Description of Artificial Sequence:  Enzymatic Nucleic Acid
ctgcagggggctagctacaacgatggcccag

SEQ ID NO: 17523 - DNA, 31 bp, Artificial Sequence
  Description of Artificial Sequence:  Enzymatic Nucleic Acid
ttgggctgggctagctacaacgaagggctgg

SEQ ID NO: 17524 - DNA, 31 bp, Artificial Sequence
  Description of Artificial Sequence:  Enzymatic Nucleic Acid
gttttgggggctagctacaacgatgcagggc

SEQ ID NO: 17525 - DNA, 31 bp, Artificial Sequence
  Description of Artificial Sequence:  Enzymatic Nucleic Acid
gccctgggggctagctacaacgatttgggct

SEQ ID NO: 17526 - DNA, 31 bp, Artificial Sequence
  Description of Artificial Sequence:  Enzymatic Nucleic Acid
gcttgttgggctagctacaacgacctgggtt

SEQ ID NO: 17527 - DNA, 31 bp, Artificial Sequence
  Description of Artificial Sequence:  Enzymatic Nucleic Acid
cgggcttgggctagctacaacgatgccctgg

SEQ ID NO: 17528 - DNA, 31 bp, Artificial Sequence
  Description of Artificial Sequence:  Enzymatic Nucleic Acid
ctaacgggggctagctacaacgattgttgcc

SEQ ID NO: 17529 - DNA, 31 bp, Artificial Sequence
  Description of Artificial Sequence:  Enzymatic Nucleic Acid
ggggctaaggctagctacaacgagggcttgt

SEQ ID NO: 17530 - DNA, 31 bp, Artificial Sequence
  Description of Artificial Sequence:  Enzymatic Nucleic Acid
ccctggggggctagctacaacgataacgggc

SEQ ID NO: 17531 - DNA, 31 bp, Artificial Sequence
  Description of Artificial Sequence:  Enzymatic Nucleic Acid
gccagtgaggctagctacaacgacccctggg

SEQ ID NO: 17532 - DNA, 31 bp, Artificial Sequence
  Description of Artificial Sequence:  Enzymatic Nucleic Acid
ccagccagggctagctacaacgagatcccct

SEQ ID NO: 17533 - DNA, 31 bp, Artificial Sequence
  Description of Artificial Sequence:  Enzymatic Nucleic Acid
caggccagggctagctacaacgacagtgatc

SEQ ID NO: 17534 - DNA, 31 bp, Artificial Sequence
  Description of Artificial Sequence:  Enzymatic Nucleic Acid
tgctcaggggctagctacaacgacagccagt

SEQ ID NO: 17535 - DNA, 31 bp, Artificial Sequence
  Description of Artificial Sequence:  Enzymatic Nucleic Acid
agatgttgggctagctacaacgatcaggcca

SEQ ID NO: 17536 - DNA, 31 bp, Artificial Sequence
  Description of Artificial Sequence:  Enzymatic Nucleic Acid
ccgagatgggctagctacaacgatgctcagg

SEQ ID NO: 17537 - DNA, 31 bp, Artificial Sequence
  Description of Artificial Sequence:  Enzymatic Nucleic Acid
tcccgagaggctagctacaacgagttgctca

SEQ ID NO: 17538 - DNA, 31 bp, Artificial Sequence
  Description of Artificial Sequence:  Enzymatic Nucleic Acid
ctagaggaggctagctacaacgatcccgaga

SEQ ID NO: 17539 - DNA, 31 bp, Artificial Sequence
  Description of Artificial Sequence:  Enzymatic Nucleic Acid
taggcctgggctagctacaacgatagaggac

SEQ ID NO: 17540 - DNA, 31 bp, Artificial Sequence
  Description of Artificial Sequence:  Enzymatic Nucleic Acid
gtcttaggggctagctacaacgactgctaga

SEQ ID NO: 17541 - DNA, 31 bp, Artificial Sequence
  Description of Artificial Sequence:  Enzymatic Nucleic Acid
ctcacatgggctagctacaacgacttaggcc

SEQ ID NO: 17542 - DNA, 31 bp, Artificial Sequence
  Description of Artificial Sequence:  Enzymatic Nucleic Acid
tcctcacaggctagctacaacgagtcttagg

SEQ ID NO: 17543 - DNA, 31 bp, Artificial Sequence
  Description of Artificial Sequence:  Enzymatic Nucleic Acid
cctcctcaggctagctacaacgaatgtctta

SEQ ID NO: 17544 - DNA, 31 bp, Artificial Sequence
  Description of Artificial Sequence:  Enzymatic Nucleic Acid
gctttttgggctagctacaacgatttttttc

SEQ ID NO: 17545 - DNA, 31 bp, Artificial Sequence
  Description of Artificial Sequence:  Enzymatic Nucleic Acid
ctcccttgggctagctacaacgatttttgct

SEQ ID NO: 17546 - DNA, 31 bp, Artificial Sequence
  Description of Artificial Sequence:  Enzymatic Nucleic Acid
tctcccggggctagctacaacgattctcttt

SEQ ID NO: 17547 - DNA, 31 bp, Artificial Sequence
  Description of Artificial Sequence:  Enzymatic Nucleic Acid
ttctcatgggctagctacaacgacttctccc

SEQ ID NO: 17548 - DNA, 31 bp, Artificial Sequence
  Description of Artificial Sequence:  Enzymatic Nucleic Acid
ctttctcaggctagctacaacgagccttctc

SEQ ID NO: 17549 - DNA, 31 bp, Artificial Sequence
  Description of Artificial Sequence:  Enzymatic Nucleic Acid
gtctcaaaggctagctacaacgatctttctc

SEQ ID NO: 17550 - DNA, 31 bp, Artificial Sequence
  Description of Artificial Sequence:  Enzymatic Nucleic Acid
atggtgcgggctagctacaacgactcaaatt

SEQ ID NO: 17551 - DNA, 31 bp, Artificial Sequence
  Description of Artificial Sequence:  Enzymatic Nucleic Acid
acatggtgggctagctacaacgagtctcaaa

SEQ ID NO: 17552 - DNA, 31 bp, Artificial Sequence
  Description of Artificial Sequence:  Enzymatic Nucleic Acid
ccacatggggctagctacaacgagcgtctca

SEQ ID NO: 17553 - DNA, 31 bp, Artificial Sequence
  Description of Artificial Sequence:  Enzymatic Nucleic Acid
tgcccacaggctagctacaacgaggtgcgtc

SEQ ID NO: 17554 - DNA, 31 bp, Artificial Sequence
  Description of Artificial Sequence:  Enzymatic Nucleic Acid
cgtgcccaggctagctacaacgaatggtgcg

SEQ ID NO: 17555 - DNA, 31 bp, Artificial Sequence
  Description of Artificial Sequence:  Enzymatic Nucleic Acid
cctccgtgggctagctacaacgaccacatgg

SEQ ID NO: 17556 - DNA, 31 bp, Artificial Sequence
  Description of Artificial Sequence:  Enzymatic Nucleic Acid
cccctccgggctagctacaacgagcccacat

SEQ ID NO: 17557 - DNA, 31 bp, Artificial Sequence
  Description of Artificial Sequence:  Enzymatic Nucleic Acid
gagccccgggctagctacaacgaccccctcc

SEQ ID NO: 17558 - DNA, 31 bp, Artificial Sequence
  Description of Artificial Sequence:  Enzymatic Nucleic Acid
ttgctgagggctagctacaacgacccgtccc

SEQ ID NO: 17559 - DNA, 31 bp, Artificial Sequence
  Description of Artificial Sequence:  Enzymatic Nucleic Acid
tggcattgggctagctacaacgatgagcccc

SEQ ID NO: 17560 - DNA, 31 bp, Artificial Sequence
  Description of Artificial Sequence:  Enzymatic Nucleic Acid
aaatggcaggctagctacaacgatgctgagc

SEQ ID NO: 17561 - DNA, 31 bp, Artificial Sequence
  Description of Artificial Sequence:  Enzymatic Nucleic Acid
tgaaatggggctagctacaacgaattgctga

SEQ ID NO: 17562 - DNA, 31 bp, Artificial Sequence
  Description of Artificial Sequence:  Enzymatic Nucleic Acid
cactgaaaggctagctacaacgaggcattgc

SEQ ID NO: 17563 - DNA, 31 bp, Artificial Sequence
  Description of Artificial Sequence:  Enzymatic Nucleic Acid
ggaagccaggctagctacaacgatgaaatgg

SEQ ID NO: 17564 - DNA, 31 bp, Artificial Sequence
  Description of Artificial Sequence:  Enzymatic Nucleic Acid
ctgggaagggctagctacaacgacactgaaa

SEQ ID NO: 17565 - DNA, 31 bp, Artificial Sequence
  Description of Artificial Sequence:  Enzymatic Nucleic Acid
ggtcagagggctagctacaacgatgggaagc

SEQ ID NO: 17566 - DNA, 31 bp, Artificial Sequence
  Description of Artificial Sequence:  Enzymatic Nucleic Acid
tagaagggggctagctacaacgacagagctg

SEQ ID NO: 17567 - DNA, 31 bp, Artificial Sequence
  Description of Artificial Sequence:  Enzymatic Nucleic Acid
ctcaaatgggctagctacaacgaagaagggt

SEQ ID NO: 17568 - DNA, 31 bp, Artificial Sequence
  Description of Artificial Sequence:  Enzymatic Nucleic Acid
ccctcaaaggctagctacaacgagtagaagg

SEQ ID NO: 17569 - DNA, 31 bp, Artificial Sequence
  Description of Artificial Sequence:  Enzymatic Nucleic Acid
tggctgggggctagctacaacgacctcaaat

SEQ ID NO: 17570 - DNA, 31 bp, Artificial Sequence
  Description of Artificial Sequence:  Enzymatic Nucleic Acid
gctcctggggctagctacaacgatgggccct

SEQ ID NO: 17571 - DNA, 31 bp, Artificial Sequence
  Description of Artificial Sequence:  Enzymatic Nucleic Acid
tccatctgggctagctacaacgatcctggct

SEQ ID NO: 17572 - DNA, 31 bp, Artificial Sequence
  Description of Artificial Sequence:  Enzymatic Nucleic Acid
gctgtccaggctagctacaacgactgctcct

SEQ ID NO: 17573 - DNA, 31 bp, Artificial Sequence
  Description of Artificial Sequence:  Enzymatic Nucleic Acid
catcgctgggctagctacaacgaccatctgc

SEQ ID NO: 17574 - DNA, 31 bp, Artificial Sequence
  Description of Artificial Sequence:  Enzymatic Nucleic Acid
cctcatcgggctagctacaacgatgtccatc

SEQ ID NO: 17575 - DNA, 31 bp, Artificial Sequence
  Description of Artificial Sequence:  Enzymatic Nucleic Acid
tcccctcaggctagctacaacgacgctgtcc

SEQ ID NO: 17576 - DNA, 31 bp, Artificial Sequence
  Description of Artificial Sequence:  Enzymatic Nucleic Acid
agaaaatgggctagctacaacgacccctcat

SEQ ID NO: 17577 - DNA, 31 bp, Artificial Sequence
  Description of Artificial Sequence:  Enzymatic Nucleic Acid
ccagaaaaggctagctacaacgagtcccctc

SEQ ID NO: 17578 - DNA, 31 bp, Artificial Sequence
  Description of Artificial Sequence:  Enzymatic Nucleic Acid
tcccagaaggctagctacaacgaccagaaaa

SEQ ID NO: 17579 - DNA, 31 bp, Artificial Sequence
  Description of Artificial Sequence:  Enzymatic Nucleic Acid
ttttcttgggctagctacaacgactcccaga

SEQ ID NO: 17580 - DNA, 31 bp, Artificial Sequence
  Description of Artificial Sequence:  Enzymatic Nucleic Acid
gatatttgggctagctacaacgaccttttct

SEQ ID NO: 17581 - DNA, 31 bp, Artificial Sequence
  Description of Artificial Sequence:  Enzymatic Nucleic Acid
aaaagataggctagctacaacgattgtcctt

SEQ ID NO: 17582 - DNA, 31 bp, Artificial Sequence
  Description of Artificial Sequence:  Enzymatic Nucleic Acid
aaaaaagaggctagctacaacgaatttgtcc

SEQ ID NO: 17583 - DNA, 31 bp, Artificial Sequence
  Description of Artificial Sequence:  Enzymatic Nucleic Acid
tgctttagggctagctacaacgatccaaaaa

SEQ ID NO: 17584 - DNA, 31 bp, Artificial Sequence
  Description of Artificial Sequence:  Enzymatic Nucleic Acid
aaaatttgggctagctacaacgatttagttc

SEQ ID NO: 17585 - DNA, 31 bp, Artificial Sequence
  Description of Artificial Sequence:  Enzymatic Nucleic Acid
gtctaaaaggctagctacaacgattgcttta

SEQ ID NO: 17586 - DNA, 31 bp, Artificial Sequence
  Description of Artificial Sequence:  Enzymatic Nucleic Acid
ggtaaaggggctagctacaacgactaaaatt

SEQ ID NO: 17587 - DNA, 31 bp, Artificial Sequence
  Description of Artificial Sequence:  Enzymatic Nucleic Acid
tccataggggctagctacaacgaaaaggtct

SEQ ID NO: 17588 - DNA, 31 bp, Artificial Sequence
  Description of Artificial Sequence:  Enzymatic Nucleic Acid
cacttccaggctagctacaacgaaggtaaag

SEQ ID NO: 17589 - DNA, 31 bp, Artificial Sequence
  Description of Artificial Sequence:  Enzymatic Nucleic Acid
tagaaccaggctagctacaacgattccatag

SEQ ID NO: 17590 - DNA, 31 bp, Artificial Sequence
  Description of Artificial Sequence:  Enzymatic Nucleic Acid
acatagaaggctagctacaacgacacttcca

SEQ ID NO: 17591 - DNA, 31 bp, Artificial Sequence
  Description of Artificial Sequence:  Enzymatic Nucleic Acid
aatggacaggctagctacaacgaagaaccac

SEQ ID NO: 17592 - DNA, 31 bp, Artificial Sequence
  Description of Artificial Sequence:  Enzymatic Nucleic Acid
agaatggaggctagctacaacgaatagaacc

SEQ ID NO: 17593 - DNA, 31 bp, Artificial Sequence
  Description of Artificial Sequence:  Enzymatic Nucleic Acid
aatgagaaggctagctacaacgaggacatag

SEQ ID NO: 17594 - DNA, 31 bp, Artificial Sequence
  Description of Artificial Sequence:  Enzymatic Nucleic Acid
gccacgaaggctagctacaacgagagaatgg

SEQ ID NO: 17595 - DNA, 31 bp, Artificial Sequence
  Description of Artificial Sequence:  Enzymatic Nucleic Acid
acatgccaggctagctacaacgagaatgaga

SEQ ID NO: 17596 - DNA, 31 bp, Artificial Sequence
  Description of Artificial Sequence:  Enzymatic Nucleic Acid
aaaacatgggctagctacaacgacacgaatg

SEQ ID NO: 17597 - DNA, 31 bp, Artificial Sequence
  Description of Artificial Sequence:  Enzymatic Nucleic Acid
tcaaaacaggctagctacaacgagccacgaa

SEQ ID NO: 17598 - DNA, 31 bp, Artificial Sequence
  Description of Artificial Sequence:  Enzymatic Nucleic Acid
aatcaaaaggctagctacaacgaatgccacg

SEQ ID NO: 17599 - DNA, 31 bp, Artificial Sequence
  Description of Artificial Sequence:  Enzymatic Nucleic Acid
gctacaaaggctagctacaacgacaaaacat

SEQ ID NO: 17600 - DNA, 31 bp, Artificial Sequence
  Description of Artificial Sequence:  Enzymatic Nucleic Acid
cagtgctaggctagctacaacgaaaatcaaa

SEQ ID NO: 17601 - DNA, 31 bp, Artificial Sequence
  Description of Artificial Sequence:  Enzymatic Nucleic Acid
cctcagtgggctagctacaacgatacaaatc

SEQ ID NO: 17602 - DNA, 31 bp, Artificial Sequence
  Description of Artificial Sequence:  Enzymatic Nucleic Acid
accctcagggctagctacaacgagctacaaa

SEQ ID NO: 17603 - DNA, 31 bp, Artificial Sequence
  Description of Artificial Sequence:  Enzymatic Nucleic Acid
gagtgccaggctagctacaacgacctcagtg

SEQ ID NO: 17604 - DNA, 31 bp, Artificial Sequence
  Description of Artificial Sequence:  Enzymatic Nucleic Acid
gttgagtgggctagctacaacgacaccctca

SEQ ID NO: 17605 - DNA, 31 bp, Artificial Sequence
  Description of Artificial Sequence:  Enzymatic Nucleic Acid
gagttgagggctagctacaacgagccaccct

SEQ ID NO: 17606 - DNA, 31 bp, Artificial Sequence
  Description of Artificial Sequence:  Enzymatic Nucleic Acid
gctcagagggctagctacaacgatgagtgcc

SEQ ID NO: 17607 - DNA, 31 bp, Artificial Sequence
  Description of Artificial Sequence:  Enzymatic Nucleic Acid
agtatgggggctagctacaacgatcagagtt

SEQ ID NO: 17608 - DNA, 31 bp, Artificial Sequence
  Description of Artificial Sequence:  Enzymatic Nucleic Acid
caaaagtaggctagctacaacgagggctcag

SEQ ID NO: 17609 - DNA, 31 bp, Artificial Sequence
  Description of Artificial Sequence:  Enzymatic Nucleic Acid
gccaaaagggctagctacaacgaatgggctc

SEQ ID NO: 17610 - DNA, 31 bp, Artificial Sequence
  Description of Artificial Sequence:  Enzymatic Nucleic Acid
tagaggagggctagctacaacgacaaaagta

SEQ ID NO: 17611 - DNA, 31 bp, Artificial Sequence
  Description of Artificial Sequence:  Enzymatic Nucleic Acid
gcatcttaggctagctacaacgatagaggag

SEQ ID NO: 17612 - DNA, 31 bp, Artificial Sequence
  Description of Artificial Sequence:  Enzymatic Nucleic Acid
tcagtgcaggctagctacaacgacttactag

SEQ ID NO: 17613 - DNA, 31 bp, Artificial Sequence
  Description of Artificial Sequence:  Enzymatic Nucleic Acid
tttcagtgggctagctacaacgaatcttact

SEQ ID NO: 17614 - DNA, 31 bp, Artificial Sequence
  Description of Artificial Sequence:  Enzymatic Nucleic Acid
gttttcagggctagctacaacgagcatctta

SEQ ID NO: 17615 - DNA, 31 bp, Artificial Sequence
  Description of Artificial Sequence:  Enzymatic Nucleic Acid
tggctaagggctagctacaacgatttcagtg

SEQ ID NO: 17616 - DNA, 31 bp, Artificial Sequence
  Description of Artificial Sequence:  Enzymatic Nucleic Acid
aactctggggctagctacaacgataagtttt

SEQ ID NO: 17617 - DNA, 31 bp, Artificial Sequence
  Description of Artificial Sequence:  Enzymatic Nucleic Acid
caacctaaggctagctacaacgatctggcta

SEQ ID NO: 17618 - DNA, 31 bp, Artificial Sequence
  Description of Artificial Sequence:  Enzymatic Nucleic Acid
ggagacaaggctagctacaacgactaactct

SEQ ID NO: 17619 - DNA, 31 bp, Artificial Sequence
  Description of Artificial Sequence:  Enzymatic Nucleic Acid
cctggagaggctagctacaacgaaacctaac

SEQ ID NO: 17620 - DNA, 31 bp, Artificial Sequence
  Description of Artificial Sequence:  Enzymatic Nucleic Acid
catcatggggctagctacaacgactggagac

SEQ ID NO: 17621 - DNA, 31 bp, Artificial Sequence
  Description of Artificial Sequence:  Enzymatic Nucleic Acid
ggccatcaggctagctacaacgaggcctgga

SEQ ID NO: 17622 - DNA, 31 bp, Artificial Sequence
  Description of Artificial Sequence:  Enzymatic Nucleic Acid
taaggccaggctagctacaacgacatggcct

SEQ ID NO: 17623 - DNA, 31 bp, Artificial Sequence
  Description of Artificial Sequence:  Enzymatic Nucleic Acid
gtgtaaggggctagctacaacgacatcatgg

SEQ ID NO: 17624 - DNA, 31 bp, Artificial Sequence
  Description of Artificial Sequence:  Enzymatic Nucleic Acid
tttcagtgggctagctacaacgaaaggccat

SEQ ID NO: 17625 - DNA, 31 bp, Artificial Sequence
  Description of Artificial Sequence:  Enzymatic Nucleic Acid
attttcagggctagctacaacgagtaaggcc

SEQ ID NO: 17626 - DNA, 31 bp, Artificial Sequence
  Description of Artificial Sequence:  Enzymatic Nucleic Acid
atgtgacaggctagctacaacgatttcagtg

SEQ ID NO: 17627 - DNA, 31 bp, Artificial Sequence
  Description of Artificial Sequence:  Enzymatic Nucleic Acid
gaatgtgaggctagctacaacgaattttcag

SEQ ID NO: 17628 - DNA, 31 bp, Artificial Sequence
  Description of Artificial Sequence:  Enzymatic Nucleic Acid
atagaatgggctagctacaacgagacatttt

SEQ ID NO: 17629 - DNA, 31 bp, Artificial Sequence
  Description of Artificial Sequence:  Enzymatic Nucleic Acid
aaatagaaggctagctacaacgagtgacatt

SEQ ID NO: 17630 - DNA, 31 bp, Artificial Sequence
  Description of Artificial Sequence:  Enzymatic Nucleic Acid
acccaaaaggctagctacaacgaagaatgtg

SEQ ID NO: 17631 - DNA, 31 bp, Artificial Sequence
  Description of Artificial Sequence:  Enzymatic Nucleic Acid
tattaataggctagctacaacgaccaaaata

SEQ ID NO: 17632 - DNA, 31 bp, Artificial Sequence
  Description of Artificial Sequence:  Enzymatic Nucleic Acid
tatattaaggctagctacaacgaacccaaaa

SEQ ID NO: 17633 - DNA, 31 bp, Artificial Sequence
  Description of Artificial Sequence:  Enzymatic Nucleic Acid
actatataggctagctacaacgataataccc

SEQ ID NO: 17634 - DNA, 31 bp, Artificial Sequence
  Description of Artificial Sequence:  Enzymatic Nucleic Acid
ggactataggctagctacaacgaattaatac

SEQ ID NO: 17635 - DNA, 31 bp, Artificial Sequence
  Description of Artificial Sequence:  Enzymatic Nucleic Acid
ctggactaggctagctacaacgaatattaat

SEQ ID NO: 17636 - DNA, 31 bp, Artificial Sequence
  Description of Artificial Sequence:  Enzymatic Nucleic Acid
tgtctggaggctagctacaacgatatatatt

SEQ ID NO: 17637 - DNA, 31 bp, Artificial Sequence
  Description of Artificial Sequence:  Enzymatic Nucleic Acid
gttaagtgggctagctacaacgactggacta

SEQ ID NO: 17638 - DNA, 31 bp, Artificial Sequence
  Description of Artificial Sequence:  Enzymatic Nucleic Acid
gagttaagggctagctacaacgagtctggac

SEQ ID NO: 17639 - DNA, 31 bp, Artificial Sequence
  Description of Artificial Sequence:  Enzymatic Nucleic Acid
aaattgagggctagctacaacgataagtgtc

SEQ ID NO: 17640 - DNA, 31 bp, Artificial Sequence
  Description of Artificial Sequence:  Enzymatic Nucleic Acid
ccaagaaaggctagctacaacgatgagttaa

SEQ ID NO: 17641 - DNA, 31 bp, Artificial Sequence
  Description of Artificial Sequence:  Enzymatic Nucleic Acid
gaataataggctagctacaacgacaagaaat

SEQ ID NO: 17642 - DNA, 31 bp, Artificial Sequence
  Description of Artificial Sequence:  Enzymatic Nucleic Acid
cagaataaggctagctacaacgaaccaagaa

SEQ ID NO: 17643 - DNA, 31 bp, Artificial Sequence
  Description of Artificial Sequence:  Enzymatic Nucleic Acid
aaacagaaggctagctacaacgaaataccaa

SEQ ID NO: 17644 - DNA, 31 bp, Artificial Sequence
  Description of Artificial Sequence:  Enzymatic Nucleic Acid
gtgcaaaaggctagctacaacgaagaataat

SEQ ID NO: 17645 - DNA, 31 bp, Artificial Sequence
  Description of Artificial Sequence:  Enzymatic Nucleic Acid
taactgtgggctagctacaacgaaaaacaga

SEQ ID NO: 17646 - DNA, 31 bp, Artificial Sequence
  Description of Artificial Sequence:  Enzymatic Nucleic Acid
actaactgggctagctacaacgagcaaaaca

SEQ ID NO: 17647 - DNA, 31 bp, Artificial Sequence
  Description of Artificial Sequence:  Enzymatic Nucleic Acid
acaactaaggctagctacaacgatgtgcaaa

SEQ ID NO: 17648 - DNA, 31 bp, Artificial Sequence
  Description of Artificial Sequence:  Enzymatic Nucleic Acid
tttcacaaggctagctacaacgataactgtg

SEQ ID NO: 17649 - DNA, 31 bp, Artificial Sequence
  Description of Artificial Sequence:  Enzymatic Nucleic Acid
ttctttcaggctagctacaacgaaactaact

SEQ ID NO: 17650 - DNA, 31 bp, Artificial Sequence
  Description of Artificial Sequence:  Enzymatic Nucleic Acid
cttctcagggctagctacaacgatttctttc

SEQ ID NO: 17651 - DNA, 31 bp, Artificial Sequence
  Description of Artificial Sequence:  Enzymatic Nucleic Acid
cattttcaggctagctacaacgatcttctca

SEQ ID NO: 17652 - DNA, 31 bp, Artificial Sequence
  Description of Artificial Sequence:  Enzymatic Nucleic Acid
ggactgcaggctagctacaacgatttcattc

SEQ ID NO: 17653 - DNA, 31 bp, Artificial Sequence
  Description of Artificial Sequence:  Enzymatic Nucleic Acid
caggactgggctagctacaacgaattttcat

SEQ ID NO: 17654 - DNA, 31 bp, Artificial Sequence
  Description of Artificial Sequence:  Enzymatic Nucleic Acid
cctcaggaggctagctacaacgatgcatttt

SEQ ID NO: 17655 - DNA, 31 bp, Artificial Sequence
  Description of Artificial Sequence:  Enzymatic Nucleic Acid
ggagaaaaggctagctacaacgatctcctca

SEQ ID NO: 17656 - DNA, 31 bp, Artificial Sequence
  Description of Artificial Sequence:  Enzymatic Nucleic Acid
ttttgataggctagctacaacgaggagaaaa

SEQ ID NO: 17657 - DNA, 31 bp, Artificial Sequence
  Description of Artificial Sequence:  Enzymatic Nucleic Acid
cgttttgaggctagctacaacgaatggagaa

SEQ ID NO: 17658 - DNA, 31 bp, Artificial Sequence
  Description of Artificial Sequence:  Enzymatic Nucleic Acid
agccctcgggctagctacaacgatttgatat

SEQ ID NO: 17659 - DNA, 31 bp, Artificial Sequence
  Description of Artificial Sequence:  Enzymatic Nucleic Acid
tccatcagggctagctacaacgacctcgttt

SEQ ID NO: 17660 - DNA, 31 bp, Artificial Sequence
  Description of Artificial Sequence:  Enzymatic Nucleic Acid
ttcctccaggctagctacaacgacagccctc

SEQ ID NO: 17661 - DNA, 31 bp, Artificial Sequence
  Description of Artificial Sequence:  Enzymatic Nucleic Acid
cttattgaggctagctacaacgactttttcc

SEQ ID NO: 17662 - DNA, 31 bp, Artificial Sequence
  Description of Artificial Sequence:  Enzymatic Nucleic Acid
tgaccttaggctagctacaacgatgaccttt

SEQ ID NO: 17663 - DNA, 31 bp, Artificial Sequence
  Description of Artificial Sequence:  Enzymatic Nucleic Acid
tcccttgaggctagctacaacgacttattga

SEQ ID NO: 17664 - DNA, 31 bp, Artificial Sequence
  Description of Artificial Sequence:  Enzymatic Nucleic Acid
agacggggggctagctacaacgacttccctt

SEQ ID NO: 17665 - DNA, 31 bp, Artificial Sequence
  Description of Artificial Sequence:  Enzymatic Nucleic Acid
tatagagaggctagctacaacgaggggtctt

SEQ ID NO: 17666 - DNA, 31 bp, Artificial Sequence
  Description of Artificial Sequence:  Enzymatic Nucleic Acid
ggttggtaggctagctacaacgaagagacgg

SEQ ID NO: 17667 - DNA, 31 bp, Artificial Sequence
  Description of Artificial Sequence:  Enzymatic Nucleic Acid
ttggttggggctagctacaacgaatagagac

SEQ ID NO: 17668 - DNA, 31 bp, Artificial Sequence
  Description of Artificial Sequence:  Enzymatic Nucleic Acid
tggtttggggctagctacaacgatggtatag

SEQ ID NO: 17669 - DNA, 31 bp, Artificial Sequence
  Description of Artificial Sequence:  Enzymatic Nucleic Acid
tgaattggggctagctacaacgattggttgg

SEQ ID NO: 17670 - DNA, 31 bp, Artificial Sequence
  Description of Artificial Sequence:  Enzymatic Nucleic Acid
ttggtgaaggctagctacaacgatggtttgg

SEQ ID NO: 17671 - DNA, 31 bp, Artificial Sequence
  Description of Artificial Sequence:  Enzymatic Nucleic Acid
tgtgttggggctagctacaacgagaattggt

SEQ ID NO: 17672 - DNA, 31 bp, Artificial Sequence
  Description of Artificial Sequence:  Enzymatic Nucleic Acid
caactgtgggctagctacaacgatggtgaat

SEQ ID NO: 17673 - DNA, 31 bp, Artificial Sequence
  Description of Artificial Sequence:  Enzymatic Nucleic Acid
cccaactgggctagctacaacgagttggtga

SEQ ID NO: 17674 - DNA, 31 bp, Artificial Sequence
  Description of Artificial Sequence:  Enzymatic Nucleic Acid
ggtcccaaggctagctacaacgatgtgttgg

SEQ ID NO: 17675 - DNA, 31 bp, Artificial Sequence
  Description of Artificial Sequence:  Enzymatic Nucleic Acid
gttttgggggctagctacaacgacccaactg

SEQ ID NO: 17676 - DNA, 31 bp, Artificial Sequence
  Description of Artificial Sequence:  Enzymatic Nucleic Acid
ttcctgtgggctagctacaacgatttgggtc

SEQ ID NO: 17677 - DNA, 31 bp, Artificial Sequence
  Description of Artificial Sequence:  Enzymatic Nucleic Acid
acttcctgggctagctacaacgagttttggg

SEQ ID NO: 17678 - DNA, 31 bp, Artificial Sequence
  Description of Artificial Sequence:  Enzymatic Nucleic Acid
gtgactgaggctagctacaacgattcctgtg

SEQ ID NO: 17679 - DNA, 31 bp, Artificial Sequence
  Description of Artificial Sequence:  Enzymatic Nucleic Acid
aaacgtgaggctagctacaacgatgacttcc

SEQ ID NO: 17680 - DNA, 31 bp, Artificial Sequence
  Description of Artificial Sequence:  Enzymatic Nucleic Acid
aggaaacgggctagctacaacgagactgact

SEQ ID NO: 17681 - DNA, 31 bp, Artificial Sequence
  Description of Artificial Sequence:  Enzymatic Nucleic Acid
aaaggaaaggctagctacaacgagtgactga

SEQ ID NO: 17682 - DNA, 31 bp, Artificial Sequence
  Description of Artificial Sequence:  Enzymatic Nucleic Acid
ccattaaaggctagctacaacgagaaaagga

SEQ ID NO: 17683 - DNA, 31 bp, Artificial Sequence
  Description of Artificial Sequence:  Enzymatic Nucleic Acid
aatccccaggctagctacaacgataaatgaa

SEQ ID NO: 17684 - DNA, 31 bp, Artificial Sequence
  Description of Artificial Sequence:  Enzymatic Nucleic Acid
tagtggaaggctagctacaacgaccccatta

SEQ ID NO: 17685 - DNA, 31 bp, Artificial Sequence
  Description of Artificial Sequence:  Enzymatic Nucleic Acid
tgagatagggctagctacaacgaggaatccc

SEQ ID NO: 17686 - DNA, 31 bp, Artificial Sequence
  Description of Artificial Sequence:  Enzymatic Nucleic Acid
gtgtgagaggctagctacaacgaagtggaat

SEQ ID NO: 17687 - DNA, 31 bp, Artificial Sequence
  Description of Artificial Sequence:  Enzymatic Nucleic Acid
gattagtgggctagctacaacgagagatagt

SEQ ID NO: 17688 - DNA, 31 bp, Artificial Sequence
  Description of Artificial Sequence:  Enzymatic Nucleic Acid
cagattagggctagctacaacgagtgagata

SEQ ID NO: 17689 - DNA, 31 bp, Artificial Sequence
  Description of Artificial Sequence:  Enzymatic Nucleic Acid
ctttcagaggctagctacaacgatagtgtga

SEQ ID NO: 17690 - DNA, 31 bp, Artificial Sequence
  Description of Artificial Sequence:  Enzymatic Nucleic Acid
cttccacaggctagctacaacgacctttcag

SEQ ID NO: 17691 - DNA, 31 bp, Artificial Sequence
  Description of Artificial Sequence:  Enzymatic Nucleic Acid
ctcttccaggctagctacaacgaatcctttc

SEQ ID NO: 17692 - DNA, 31 bp, Artificial Sequence
  Description of Artificial Sequence:  Enzymatic Nucleic Acid
agctaatgggctagctacaacgatcttccac

SEQ ID NO: 17693 - DNA, 31 bp, Artificial Sequence
  Description of Artificial Sequence:  Enzymatic Nucleic Acid
ccagctaaggctagctacaacgagctcttcc

SEQ ID NO: 17694 - DNA, 31 bp, Artificial Sequence
  Description of Artificial Sequence:  Enzymatic Nucleic Acid
tgcgccagggctagctacaacgataatgctc

SEQ ID NO: 17695 - DNA, 31 bp, Artificial Sequence
  Description of Artificial Sequence:  Enzymatic Nucleic Acid
aatatgcgggctagctacaacgacagctaat

SEQ ID NO: 17696 - DNA, 31 bp, Artificial Sequence
  Description of Artificial Sequence:  Enzymatic Nucleic Acid
ttaatatgggctagctacaacgagccagcta

SEQ ID NO: 17697 - DNA, 31 bp, Artificial Sequence
  Description of Artificial Sequence:  Enzymatic Nucleic Acid
gcttaataggctagctacaacgagcgccagc

SEQ ID NO: 17698 - DNA, 31 bp, Artificial Sequence
  Description of Artificial Sequence:  Enzymatic Nucleic Acid
gtgcttaaggctagctacaacgaatgcgcca

SEQ ID NO: 17699 - DNA, 31 bp, Artificial Sequence
  Description of Artificial Sequence:  Enzymatic Nucleic Acid
ttaaagtgggctagctacaacgattaatatg

SEQ ID NO: 17700 - DNA, 31 bp, Artificial Sequence
  Description of Artificial Sequence:  Enzymatic Nucleic Acid
gcttaaagggctagctacaacgagcttaata

SEQ ID NO: 17701 - DNA, 31 bp, Artificial Sequence
  Description of Artificial Sequence:  Enzymatic Nucleic Acid
tcaaggagggctagctacaacgattaaagtg

SEQ ID NO: 17702 - DNA, 31 bp, Artificial Sequence
  Description of Artificial Sequence:  Enzymatic Nucleic Acid
cctttttaggctagctacaacgatcaaggag

SEQ ID NO: 17703 - DNA, 31 bp, Artificial Sequence
  Description of Artificial Sequence:  Enzymatic Nucleic Acid
acataccaggctagctacaacgactttttac

SEQ ID NO: 17704 - DNA, 31 bp, Artificial Sequence
  Description of Artificial Sequence:  Enzymatic Nucleic Acid
attacataggctagctacaacgacacctttt

SEQ ID NO: 17705 - DNA, 31 bp, Artificial Sequence
  Description of Artificial Sequence:  Enzymatic Nucleic Acid
aaattacaggctagctacaacgaaccacctt

SEQ ID NO: 17706 - DNA, 31 bp, Artificial Sequence
  Description of Artificial Sequence:  Enzymatic Nucleic Acid
ataaattaggctagctacaacgaataccacc

SEQ ID NO: 17707 - DNA, 31 bp, Artificial Sequence
  Description of Artificial Sequence:  Enzymatic Nucleic Acid
tgcataaaggctagctacaacgatacatacc

SEQ ID NO: 17708 - DNA, 31 bp, Artificial Sequence
  Description of Artificial Sequence:  Enzymatic Nucleic Acid
accttgcaggctagctacaacgaaaattaca

SEQ ID NO: 17709 - DNA, 31 bp, Artificial Sequence
  Description of Artificial Sequence:  Enzymatic Nucleic Acid
ataccttgggctagctacaacgaataaatta

SEQ ID NO: 17710 - DNA, 31 bp, Artificial Sequence
  Description of Artificial Sequence:  Enzymatic Nucleic Acid
gagaaataggctagctacaacgacttgcata

SEQ ID NO: 17711 - DNA, 31 bp, Artificial Sequence
  Description of Artificial Sequence:  Enzymatic Nucleic Acid
tggagaaaggctagctacaacgaaccttgca

SEQ ID NO: 17712 - DNA, 31 bp, Artificial Sequence
  Description of Artificial Sequence:  Enzymatic Nucleic Acid
agtcccaaggctagctacaacgatggagaaa

SEQ ID NO: 17713 - DNA, 31 bp, Artificial Sequence
  Description of Artificial Sequence:  Enzymatic Nucleic Acid
atcctgagggctagctacaacgacccaactg

SEQ ID NO: 17714 - DNA, 31 bp, Artificial Sequence
  Description of Artificial Sequence:  Enzymatic Nucleic Acid
aactaataggctagctacaacgacctgagtc

SEQ ID NO: 17715 - DNA, 31 bp, Artificial Sequence
  Description of Artificial Sequence:  Enzymatic Nucleic Acid
ttaactaaggctagctacaacgaatcctgag

SEQ ID NO: 17716 - DNA, 31 bp, Artificial Sequence
  Description of Artificial Sequence:  Enzymatic Nucleic Acid
ctcattaaggctagctacaacgataatatcc

SEQ ID NO: 17717 - DNA, 31 bp, Artificial Sequence
  Description of Artificial Sequence:  Enzymatic Nucleic Acid
atggctcaggctagctacaacgataactaat

SEQ ID NO: 17718 - DNA, 31 bp, Artificial Sequence
  Description of Artificial Sequence:  Enzymatic Nucleic Acid
agtgatggggctagctacaacgatcattaac

SEQ ID NO: 17719 - DNA, 31 bp, Artificial Sequence
  Description of Artificial Sequence:  Enzymatic Nucleic Acid
tctagtgaggctagctacaacgaggctcatt

SEQ ID NO: 17720 - DNA, 31 bp, Artificial Sequence
  Description of Artificial Sequence:  Enzymatic Nucleic Acid
tcttctagggctagctacaacgagatggctc

SEQ ID NO: 17721 - DNA, 31 bp, Artificial Sequence
  Description of Artificial Sequence:  Enzymatic Nucleic Acid
aaaatgggggctagctacaacgattttcttc

SEQ ID NO: 17722 - DNA, 31 bp, Artificial Sequence
  Description of Artificial Sequence:  Enzymatic Nucleic Acid
gttgaaaaggctagctacaacgagggctttt

SEQ ID NO: 17723 - DNA, 31 bp, Artificial Sequence
  Description of Artificial Sequence:  Enzymatic Nucleic Acid
caaagcagggctagctacaacgatgaaaatg

SEQ ID NO: 17724 - DNA, 31 bp, Artificial Sequence
  Description of Artificial Sequence:  Enzymatic Nucleic Acid
tttcaaagggctagctacaacgaagttgaaa

SEQ ID NO: 17725 - DNA, 31 bp, Artificial Sequence
  Description of Artificial Sequence:  Enzymatic Nucleic Acid
caggcaagggctagctacaacgattcaaagc

SEQ ID NO: 17726 - DNA, 31 bp, Artificial Sequence
  Description of Artificial Sequence:  Enzymatic Nucleic Acid
accccaggggctagctacaacgaaagtttca

SEQ ID NO: 17727 - DNA, 31 bp, Artificial Sequence
  Description of Artificial Sequence:  Enzymatic Nucleic Acid
tgctcagaggctagctacaacgacccaggca

SEQ ID NO: 17728 - DNA, 31 bp, Artificial Sequence
  Description of Artificial Sequence:  Enzymatic Nucleic Acid
ccatcatgggctagctacaacgatcagaccc

SEQ ID NO: 17729 - DNA, 31 bp, Artificial Sequence
  Description of Artificial Sequence:  Enzymatic Nucleic Acid
tcccatcaggctagctacaacgagctcagac

SEQ ID NO: 17730 - DNA, 31 bp, Artificial Sequence
  Description of Artificial Sequence:  Enzymatic Nucleic Acid
tattcccaggctagctacaacgacatgctca

SEQ ID NO: 17731 - DNA, 31 bp, Artificial Sequence
  Description of Artificial Sequence:  Enzymatic Nucleic Acid
tctccctaggctagctacaacgatcccatca

SEQ ID NO: 17732 - DNA, 31 bp, Artificial Sequence
  Description of Artificial Sequence:  Enzymatic Nucleic Acid
ctaccctgggctagctacaacgactccctat

SEQ ID NO: 17733 - DNA, 31 bp, Artificial Sequence
  Description of Artificial Sequence:  Enzymatic Nucleic Acid
ctttcctaggctagctacaacgacctgtctc

SEQ ID NO: 17734 - DNA, 31 bp, Artificial Sequence
  Description of Artificial Sequence:  Enzymatic Nucleic Acid
agtaggcgggctagctacaacgacctttcct

SEQ ID NO: 17735 - DNA, 31 bp, Artificial Sequence
  Description of Artificial Sequence:  Enzymatic Nucleic Acid
agagtaggggctagctacaacgagccctttc

SEQ ID NO: 17736 - DNA, 31 bp, Artificial Sequence
  Description of Artificial Sequence:  Enzymatic Nucleic Acid
ctgaagagggctagctacaacgaaggcgccc

SEQ ID NO: 17737 - DNA, 31 bp, Artificial Sequence
  Description of Artificial Sequence:  Enzymatic Nucleic Acid
tctttagaggctagctacaacgacctgaaga

SEQ ID NO: 17738 - DNA, 31 bp, Artificial Sequence
  Description of Artificial Sequence:  Enzymatic Nucleic Acid
ccacttgaggctagctacaacgactttagac

SEQ ID NO: 17739 - DNA, 31 bp, Artificial Sequence
  Description of Artificial Sequence:  Enzymatic Nucleic Acid
aaggcccaggctagctacaacgattgatctt

SEQ ID NO: 17740 - DNA, 31 bp, Artificial Sequence
  Description of Artificial Sequence:  Enzymatic Nucleic Acid
atccaaggggctagctacaacgaccacttga

SEQ ID NO: 17741 - DNA, 31 bp, Artificial Sequence
  Description of Artificial Sequence:  Enzymatic Nucleic Acid
cttagcgaggctagctacaacgaccaaggcc

SEQ ID NO: 17742 - DNA, 31 bp, Artificial Sequence
  Description of Artificial Sequence:  Enzymatic Nucleic Acid
cagcttagggctagctacaacgagatccaag

SEQ ID NO: 17743 - DNA, 31 bp, Artificial Sequence
  Description of Artificial Sequence:  Enzymatic Nucleic Acid
agagccagggctagctacaacgattagcgat

SEQ ID NO: 17744 - DNA, 31 bp, Artificial Sequence
  Description of Artificial Sequence:  Enzymatic Nucleic Acid
aaacagagggctagctacaacgacagcttag

SEQ ID NO: 17745 - DNA, 31 bp, Artificial Sequence
  Description of Artificial Sequence:  Enzymatic Nucleic Acid
gcatcaaaggctagctacaacgaagagccag

SEQ ID NO: 17746 - DNA, 31 bp, Artificial Sequence
  Description of Artificial Sequence:  Enzymatic Nucleic Acid
aaatagcaggctagctacaacgacaaacaga

SEQ ID NO: 17747 - DNA, 31 bp, Artificial Sequence
  Description of Artificial Sequence:  Enzymatic Nucleic Acid
ataaatagggctagctacaacgaatcaaaca

SEQ ID NO: 17748 - DNA, 31 bp, Artificial Sequence
  Description of Artificial Sequence:  Enzymatic Nucleic Acid
tgcataaaggctagctacaacgaagcatcaa

SEQ ID NO: 17749 - DNA, 31 bp, Artificial Sequence
  Description of Artificial Sequence:  Enzymatic Nucleic Acid
aacttgcaggctagctacaacgaaaatagca

SEQ ID NO: 17750 - DNA, 31 bp, Artificial Sequence
  Description of Artificial Sequence:  Enzymatic Nucleic Acid
ctaacttgggctagctacaacgaataaatag

SEQ ID NO: 17751 - DNA, 31 bp, Artificial Sequence
  Description of Artificial Sequence:  Enzymatic Nucleic Acid
gaccctaaggctagctacaacgattgcataa

SEQ ID NO: 17752 - DNA, 31 bp, Artificial Sequence
  Description of Artificial Sequence:  Enzymatic Nucleic Acid
tacatagaggctagctacaacgacctaactt

SEQ ID NO: 17753 - DNA, 31 bp, Artificial Sequence
  Description of Artificial Sequence:  Enzymatic Nucleic Acid
taaatacaggctagctacaacgaagacccta

SEQ ID NO: 17754 - DNA, 31 bp, Artificial Sequence
  Description of Artificial Sequence:  Enzymatic Nucleic Acid
cctaaataggctagctacaacgaatagaccc

SEQ ID NO: 17755 - DNA, 31 bp, Artificial Sequence
  Description of Artificial Sequence:  Enzymatic Nucleic Acid
atcctaaaggctagctacaacgaacatagac

SEQ ID NO: 17756 - DNA, 31 bp, Artificial Sequence
  Description of Artificial Sequence:  Enzymatic Nucleic Acid
taggcgcaggctagctacaacgacctaaata

SEQ ID NO: 17757 - DNA, 31 bp, Artificial Sequence
  Description of Artificial Sequence:  Enzymatic Nucleic Acid
agtaggcgggctagctacaacgaatcctaaa

SEQ ID NO: 17758 - DNA, 31 bp, Artificial Sequence
  Description of Artificial Sequence:  Enzymatic Nucleic Acid
agagtaggggctagctacaacgagcatccta

SEQ ID NO: 17759 - DNA, 31 bp, Artificial Sequence
  Description of Artificial Sequence:  Enzymatic Nucleic Acid
ctgaagagggctagctacaacgaaggcgcat

SEQ ID NO: 17760 - DNA, 31 bp, Artificial Sequence
  Description of Artificial Sequence:  Enzymatic Nucleic Acid
tgcagacaggctagctacaacgacctaaata

SEQ ID NO: 17761 - DNA, 31 bp, Artificial Sequence
  Description of Artificial Sequence:  Enzymatic Nucleic Acid
ggtgcagaggctagctacaacgaatcctaaa

SEQ ID NO: 17762 - DNA, 31 bp, Artificial Sequence
  Description of Artificial Sequence:  Enzymatic Nucleic Acid
agaaggtgggctagctacaacgaagacatcc

SEQ ID NO: 17763 - DNA, 31 bp, Artificial Sequence
  Description of Artificial Sequence:  Enzymatic Nucleic Acid
gcagaaggggctagctacaacgagcagacat

SEQ ID NO: 17764 - DNA, 31 bp, Artificial Sequence
  Description of Artificial Sequence:  Enzymatic Nucleic Acid
actggctgggctagctacaacgaagaaggtg

SEQ ID NO: 17765 - DNA, 31 bp, Artificial Sequence
  Description of Artificial Sequence:  Enzymatic Nucleic Acid
ctgactggggctagctacaacgatgcagaag

SEQ ID NO: 17766 - DNA, 31 bp, Artificial Sequence
  Description of Artificial Sequence:  Enzymatic Nucleic Acid
gcttctgaggctagctacaacgatggctgca

SEQ ID NO: 17767 - DNA, 31 bp, Artificial Sequence
  Description of Artificial Sequence:  Enzymatic Nucleic Acid
ctctccagggctagctacaacgattctgact

SEQ ID NO: 17768 - DNA, 31 bp, Artificial Sequence
  Description of Artificial Sequence:  Enzymatic Nucleic Acid
cactgttgggctagctacaacgactctccag

SEQ ID NO: 17769 - DNA, 31 bp, Artificial Sequence
  Description of Artificial Sequence:  Enzymatic Nucleic Acid
atccactgggctagctacaacgatgcctctc

SEQ ID NO: 17770 - DNA, 31 bp, Artificial Sequence
  Description of Artificial Sequence:  Enzymatic Nucleic Acid
gcaatccaggctagctacaacgatgttgcct

SEQ ID NO: 17771 - DNA, 31 bp, Artificial Sequence
  Description of Artificial Sequence:  Enzymatic Nucleic Acid
agcagcaaggctagctacaacgaccactgtt

SEQ ID NO: 17772 - DNA, 31 bp, Artificial Sequence
  Description of Artificial Sequence:  Enzymatic Nucleic Acid
agaagcagggctagctacaacgaaatccact

SEQ ID NO: 17773 - DNA, 31 bp, Artificial Sequence
  Description of Artificial Sequence:  Enzymatic Nucleic Acid
ccaagaagggctagctacaacgaagcaatcc

SEQ ID NO: 17774 - DNA, 31 bp, Artificial Sequence
  Description of Artificial Sequence:  Enzymatic Nucleic Acid
gaagcataggctagctacaacgatcttctcc

SEQ ID NO: 17775 - DNA, 31 bp, Artificial Sequence
  Description of Artificial Sequence:  Enzymatic Nucleic Acid
aggaagcaggctagctacaacgaactcttct

SEQ ID NO: 17776 - DNA, 31 bp, Artificial Sequence
  Description of Artificial Sequence:  Enzymatic Nucleic Acid
aaaggaagggctagctacaacgaatactctt

SEQ ID NO: 17777 - DNA, 31 bp, Artificial Sequence
  Description of Artificial Sequence:  Enzymatic Nucleic Acid
tacatggaggctagctacaacgaaaaaggaa

SEQ ID NO: 17778 - DNA, 31 bp, Artificial Sequence
  Description of Artificial Sequence:  Enzymatic Nucleic Acid
aaattacaggctagctacaacgaggataaaa

SEQ ID NO: 17779 - DNA, 31 bp, Artificial Sequence
  Description of Artificial Sequence:  Enzymatic Nucleic Acid
ttaaattaggctagctacaacgaatggataa

SEQ ID NO: 17780 - DNA, 31 bp, Artificial Sequence
  Description of Artificial Sequence:  Enzymatic Nucleic Acid
cagttaaaggctagctacaacgatacatgga

SEQ ID NO: 17781 - DNA, 31 bp, Artificial Sequence
  Description of Artificial Sequence:  Enzymatic Nucleic Acid
ttctacagggctagctacaacgataaattac

SEQ ID NO: 17782 - DNA, 31 bp, Artificial Sequence
  Description of Artificial Sequence:  Enzymatic Nucleic Acid
aggttctaggctagctacaacgaagttaaat

SEQ ID NO: 17783 - DNA, 31 bp, Artificial Sequence
  Description of Artificial Sequence:  Enzymatic Nucleic Acid
agctcaggggctagctacaacgatctacagt

SEQ ID NO: 17784 - DNA, 31 bp, Artificial Sequence
  Description of Artificial Sequence:  Enzymatic Nucleic Acid
acttagagggctagctacaacgatcaggttc

SEQ ID NO: 17785 - DNA, 31 bp, Artificial Sequence
  Description of Artificial Sequence:  Enzymatic Nucleic Acid
ttcggttaggctagctacaacgattagagct

SEQ ID NO: 17786 - DNA, 31 bp, Artificial Sequence
  Description of Artificial Sequence:  Enzymatic Nucleic Acid
ttcttcggggctagctacaacgatacttaga

SEQ ID NO: 17787 - DNA, 31 bp, Artificial Sequence
  Description of Artificial Sequence:  Enzymatic Nucleic Acid
ggcatacaggctagctacaacgatcttcggt

SEQ ID NO: 17788 - DNA, 31 bp, Artificial Sequence
  Description of Artificial Sequence:  Enzymatic Nucleic Acid
gaggcataggctagctacaacgaattcttcg

SEQ ID NO: 17789 - DNA, 31 bp, Artificial Sequence
  Description of Artificial Sequence:  Enzymatic Nucleic Acid
cagaggcaggctagctacaacgaacattctt

SEQ ID NO: 17790 - DNA, 31 bp, Artificial Sequence
  Description of Artificial Sequence:  Enzymatic Nucleic Acid
aacagaggggctagctacaacgaatacattc

SEQ ID NO: 17791 - DNA, 31 bp, Artificial Sequence
  Description of Artificial Sequence:  Enzymatic Nucleic Acid
cataagaaggctagctacaacgaagaggcat

SEQ ID NO: 17792 - DNA, 31 bp, Artificial Sequence
  Description of Artificial Sequence:  Enzymatic Nucleic Acid
gtggcacaggctagctacaacgaaagaacag

SEQ ID NO: 17793 - DNA, 31 bp, Artificial Sequence
  Description of Artificial Sequence:  Enzymatic Nucleic Acid
atgtggcaggctagctacaacgaataagaac

SEQ ID NO: 17794 - DNA, 31 bp, Artificial Sequence
  Description of Artificial Sequence:  Enzymatic Nucleic Acid
ggatgtggggctagctacaacgaacataaga

SEQ ID NO: 17795 - DNA, 31 bp, Artificial Sequence
  Description of Artificial Sequence:  Enzymatic Nucleic Acid
caaggatgggctagctacaacgaggcacata

SEQ ID NO: 17796 - DNA, 31 bp, Artificial Sequence
  Description of Artificial Sequence:  Enzymatic Nucleic Acid
aacaaggaggctagctacaacgagtggcaca

SEQ ID NO: 17797 - DNA, 31 bp, Artificial Sequence
  Description of Artificial Sequence:  Enzymatic Nucleic Acid
cctttaaaggctagctacaacgaaaggatgt

SEQ ID NO: 17798 - DNA, 31 bp, Artificial Sequence
  Description of Artificial Sequence:  Enzymatic Nucleic Acid
acagagagggctagctacaacgactttaaac

SEQ ID NO: 17799 - DNA, 31 bp, Artificial Sequence
  Description of Artificial Sequence:  Enzymatic Nucleic Acid
tcttcataggctagctacaacgaagagagcc

SEQ ID NO: 17800 - DNA, 31 bp, Artificial Sequence
  Description of Artificial Sequence:  Enzymatic Nucleic Acid
tctcttcaggctagctacaacgaacagagag

SEQ ID NO: 17801 - DNA, 31 bp, Artificial Sequence
  Description of Artificial Sequence:  Enzymatic Nucleic Acid
cggtcccaggctagctacaacgactcttcat

SEQ ID NO: 17802 - DNA, 31 bp, Artificial Sequence
  Description of Artificial Sequence:  Enzymatic Nucleic Acid
gatgacggggctagctacaacgacccatctc

SEQ ID NO: 17803 - DNA, 31 bp, Artificial Sequence
  Description of Artificial Sequence:  Enzymatic Nucleic Acid
gctgatgaggctagctacaacgaggtcccat

SEQ ID NO: 17804 - DNA, 31 bp, Artificial Sequence
  Description of Artificial Sequence:  Enzymatic Nucleic Acid
tgtgctgaggctagctacaacgagacggtcc

SEQ ID NO: 17805 - DNA, 31 bp, Artificial Sequence
  Description of Artificial Sequence:  Enzymatic Nucleic Acid
ggaatgtgggctagctacaacgatgatgacg

SEQ ID NO: 17806 - DNA, 31 bp, Artificial Sequence
  Description of Artificial Sequence:  Enzymatic Nucleic Acid
agggaatgggctagctacaacgagctgatga

SEQ ID NO: 17807 - DNA, 31 bp, Artificial Sequence
  Description of Artificial Sequence:  Enzymatic Nucleic Acid
ctagggaaggctagctacaacgagtgctgat

SEQ ID NO: 17808 - DNA, 31 bp, Artificial Sequence
  Description of Artificial Sequence:  Enzymatic Nucleic Acid
taggctcaggctagctacaacgatagggaat

SEQ ID NO: 17809 - DNA, 31 bp, Artificial Sequence
  Description of Artificial Sequence:  Enzymatic Nucleic Acid
ccagtaggggctagctacaacgatcactagg

SEQ ID NO: 17810 - DNA, 31 bp, Artificial Sequence
  Description of Artificial Sequence:  Enzymatic Nucleic Acid
ggagccagggctagctacaacgaaggctcac

SEQ ID NO: 17811 - DNA, 31 bp, Artificial Sequence
  Description of Artificial Sequence:  Enzymatic Nucleic Acid
gccaggagggctagctacaacgacagtaggc

SEQ ID NO: 17812 - DNA, 31 bp, Artificial Sequence
  Description of Artificial Sequence:  Enzymatic Nucleic Acid
agccgctgggctagctacaacgacaggagcc

SEQ ID NO: 17813 - DNA, 31 bp, Artificial Sequence
  Description of Artificial Sequence:  Enzymatic Nucleic Acid
aaaagccgggctagctacaacgatgccagga

SEQ ID NO: 17814 - DNA, 31 bp, Artificial Sequence
  Description of Artificial Sequence:  Enzymatic Nucleic Acid
cacaaaagggctagctacaacgacgctgcca

SEQ ID NO: 17815 - DNA, 31 bp, Artificial Sequence
  Description of Artificial Sequence:  Enzymatic Nucleic Acid
gtcttccaggctagctacaacgaaaaagccg

SEQ ID NO: 17816 - DNA, 31 bp, Artificial Sequence
  Description of Artificial Sequence:  Enzymatic Nucleic Acid
ctagtgagggctagctacaacgacttccaca

SEQ ID NO: 17817 - DNA, 31 bp, Artificial Sequence
  Description of Artificial Sequence:  Enzymatic Nucleic Acid
ctggctagggctagctacaacgagagtcttc

SEQ ID NO: 17818 - DNA, 31 bp, Artificial Sequence
  Description of Artificial Sequence:  Enzymatic Nucleic Acid
tcttctggggctagctacaacgatagtgagt

SEQ ID NO: 17819 - DNA, 31 bp, Artificial Sequence
  Description of Artificial Sequence:  Enzymatic Nucleic Acid
ctgtcccaggctagctacaacgatcctctct

SEQ ID NO: 17820 - DNA, 31 bp, Artificial Sequence
  Description of Artificial Sequence:  Enzymatic Nucleic Acid
gaggactgggctagctacaacgacccactcc

SEQ ID NO: 17821 - DNA, 31 bp, Artificial Sequence
  Description of Artificial Sequence:  Enzymatic Nucleic Acid
ggagaggaggctagctacaacgatgtcccac

SEQ ID NO: 17822 - DNA, 31 bp, Artificial Sequence
  Description of Artificial Sequence:  Enzymatic Nucleic Acid
gatcttggggctagctacaacgaggagagga

SEQ ID NO: 17823 - DNA, 31 bp, Artificial Sequence
  Description of Artificial Sequence:  Enzymatic Nucleic Acid
gatttagaggctagctacaacgacttggtgg

SEQ ID NO: 17824 - DNA, 31 bp, Artificial Sequence
  Description of Artificial Sequence:  Enzymatic Nucleic Acid
tgtttggaggctagctacaacgattagatct

SEQ ID NO: 17825 - DNA, 31 bp, Artificial Sequence
  Description of Artificial Sequence:  Enzymatic Nucleic Acid
tgcttttgggctagctacaacgattggattt

SEQ ID NO: 17826 - DNA, 31 bp, Artificial Sequence
  Description of Artificial Sequence:  Enzymatic Nucleic Acid
ctagcctgggctagctacaacgattttgttt

SEQ ID NO: 17827 - DNA, 31 bp, Artificial Sequence
  Description of Artificial Sequence:  Enzymatic Nucleic Acid
ggctctagggctagctacaacgactgctttt

SEQ ID NO: 17828 - DNA, 31 bp, Artificial Sequence
  Description of Artificial Sequence:  Enzymatic Nucleic Acid
tcttctggggctagctacaacgatctagcct

SEQ ID NO: 17829 - DNA, 31 bp, Artificial Sequence
  Description of Artificial Sequence:  Enzymatic Nucleic Acid
aagatttgggctagctacaacgacctctctt

SEQ ID NO: 17830 - DNA, 31 bp, Artificial Sequence
  Description of Artificial Sequence:  Enzymatic Nucleic Acid
aacaaagaggctagctacaacgattgtcctc

SEQ ID NO: 17831 - DNA, 31 bp, Artificial Sequence
  Description of Artificial Sequence:  Enzymatic Nucleic Acid
aggaacaaggctagctacaacgaaaagattt

SEQ ID NO: 17832 - DNA, 31 bp, Artificial Sequence
  Description of Artificial Sequence:  Enzymatic Nucleic Acid
aagaggaaggctagctacaacgaaacaaaga

SEQ ID NO: 17833 - DNA, 31 bp, Artificial Sequence
  Description of Artificial Sequence:  Enzymatic Nucleic Acid
cgtatgtgggctagctacaacgaaaagaaga

SEQ ID NO: 17834 - DNA, 31 bp, Artificial Sequence
  Description of Artificial Sequence:  Enzymatic Nucleic Acid
tgcgtatgggctagctacaacgagtaaagaa

SEQ ID NO: 17835 - DNA, 31 bp, Artificial Sequence
  Description of Artificial Sequence:  Enzymatic Nucleic Acid
tttgcgtaggctagctacaacgagtgtaaag

SEQ ID NO: 17836 - DNA, 31 bp, Artificial Sequence
  Description of Artificial Sequence:  Enzymatic Nucleic Acid
ggtttgcgggctagctacaacgaatgtgtaa

SEQ ID NO: 17837 - DNA, 31 bp, Artificial Sequence
  Description of Artificial Sequence:  Enzymatic Nucleic Acid
gtggtttgggctagctacaacgagtatgtgt

SEQ ID NO: 17838 - DNA, 31 bp, Artificial Sequence
  Description of Artificial Sequence:  Enzymatic Nucleic Acid
acaggtggggctagctacaacgattgcgtat

SEQ ID NO: 17839 - DNA, 31 bp, Artificial Sequence
  Description of Artificial Sequence:  Enzymatic Nucleic Acid
gtcacaggggctagctacaacgaggtttgcg

SEQ ID NO: 17840 - DNA, 31 bp, Artificial Sequence
  Description of Artificial Sequence:  Enzymatic Nucleic Acid
agctgtcaggctagctacaacgaaggtggtt

SEQ ID NO: 17841 - DNA, 31 bp, Artificial Sequence
  Description of Artificial Sequence:  Enzymatic Nucleic Acid
gccagctgggctagctacaacgacacaggtg

SEQ ID NO: 17842 - DNA, 31 bp, Artificial Sequence
  Description of Artificial Sequence:  Enzymatic Nucleic Acid
attgccagggctagctacaacgatgtcacag

SEQ ID NO: 17843 - DNA, 31 bp, Artificial Sequence
  Description of Artificial Sequence:  Enzymatic Nucleic Acid
taaaattgggctagctacaacgacagctgtc

SEQ ID NO: 17844 - DNA, 31 bp, Artificial Sequence
  Description of Artificial Sequence:  Enzymatic Nucleic Acid
ttataaaaggctagctacaacgatgccagct

SEQ ID NO: 17845 - DNA, 31 bp, Artificial Sequence
  Description of Artificial Sequence:  Enzymatic Nucleic Acid
ctgatttaggctagctacaacgaaaaattgc

SEQ ID NO: 17846 - DNA, 31 bp, Artificial Sequence
  Description of Artificial Sequence:  Enzymatic Nucleic Acid
ttacctgaggctagctacaacgattataaaa

SEQ ID NO: 17847 - DNA, 31 bp, Artificial Sequence
  Description of Artificial Sequence:  Enzymatic Nucleic Acid
tccagttaggctagctacaacgactgattta

SEQ ID NO: 17848 - DNA, 31 bp, Artificial Sequence
  Description of Artificial Sequence:  Enzymatic Nucleic Acid
ccttccagggctagctacaacgatacctgat

SEQ ID NO: 17849 - DNA, 31 bp, Artificial Sequence
  Description of Artificial Sequence:  Enzymatic Nucleic Acid
gagtttaaggctagctacaacgactccttcc

SEQ ID NO: 17850 - DNA, 31 bp, Artificial Sequence
  Description of Artificial Sequence:  Enzymatic Nucleic Acid
tttctgagggctagctacaacgattaacctc

SEQ ID NO: 17851 - DNA, 31 bp, Artificial Sequence
  Description of Artificial Sequence:  Enzymatic Nucleic Acid
gactgaggggctagctacaacgacttctttt

SEQ ID NO: 17852 - DNA, 31 bp, Artificial Sequence
  Description of Artificial Sequence:  Enzymatic Nucleic Acid
agaattgaggctagctacaacgatgaggtct

SEQ ID NO: 17853 - DNA, 31 bp, Artificial Sequence
  Description of Artificial Sequence:  Enzymatic Nucleic Acid
gtagagaaggctagctacaacgatgactgag

SEQ ID NO: 17854 - DNA, 31 bp, Artificial Sequence
  Description of Artificial Sequence:  Enzymatic Nucleic Acid
aaaaaaagggctagctacaacgaagagaatt

SEQ ID NO: 17855 - DNA, 31 bp, Artificial Sequence
  Description of Artificial Sequence:  Enzymatic Nucleic Acid
ttatctgaggctagctacaacgattggaaaa

SEQ ID NO: 17856 - DNA, 31 bp, Artificial Sequence
  Description of Artificial Sequence:  Enzymatic Nucleic Acid
ggctattaggctagctacaacgactgatttg

SEQ ID NO: 17857 - DNA, 31 bp, Artificial Sequence
  Description of Artificial Sequence:  Enzymatic Nucleic Acid
ctgggctaggctagctacaacgatatctgat

SEQ ID NO: 17858 - DNA, 31 bp, Artificial Sequence
  Description of Artificial Sequence:  Enzymatic Nucleic Acid
ttgctgggggctagctacaacgatattatct

SEQ ID NO: 17859 - DNA, 31 bp, Artificial Sequence
  Description of Artificial Sequence:  Enzymatic Nucleic Acid
actatttgggctagctacaacgatgggctat

SEQ ID NO: 17860 - DNA, 31 bp, Artificial Sequence
  Description of Artificial Sequence:  Enzymatic Nucleic Acid
tatcactaggctagctacaacgattgctggg

SEQ ID NO: 17861 - DNA, 31 bp, Artificial Sequence
  Description of Artificial Sequence:  Enzymatic Nucleic Acid
tgttatcaggctagctacaacgatatttgct

SEQ ID NO: 17862 - DNA, 31 bp, Artificial Sequence
  Description of Artificial Sequence:  Enzymatic Nucleic Acid
atttgttaggctagctacaacgacactattt

SEQ ID NO: 17863 - DNA, 31 bp, Artificial Sequence
  Description of Artificial Sequence:  Enzymatic Nucleic Acid
tttatttgggctagctacaacgatatcacta

SEQ ID NO: 17864 - DNA, 31 bp, Artificial Sequence
  Description of Artificial Sequence:  Enzymatic Nucleic Acid
aggttttaggctagctacaacgattgttatc

SEQ ID NO: 17865 - DNA, 31 bp, Artificial Sequence
  Description of Artificial Sequence:  Enzymatic Nucleic Acid
agctaaggggctagctacaacgatttatttg

SEQ ID NO: 17866 - DNA, 31 bp, Artificial Sequence
  Description of Artificial Sequence:  Enzymatic Nucleic Acid
atgaacagggctagctacaacgataaggttt

SEQ ID NO: 17867 - DNA, 31 bp, Artificial Sequence
  Description of Artificial Sequence:  Enzymatic Nucleic Acid
gacatgaaggctagctacaacgaagctaagg

SEQ ID NO: 17868 - DNA, 31 bp, Artificial Sequence
  Description of Artificial Sequence:  Enzymatic Nucleic Acid
tcaagacaggctagctacaacgagaacagct

SEQ ID NO: 17869 - DNA, 31 bp, Artificial Sequence
  Description of Artificial Sequence:  Enzymatic Nucleic Acid
aatcaagaggctagctacaacgaatgaacag

SEQ ID NO: 17870 - DNA, 31 bp, Artificial Sequence
  Description of Artificial Sequence:  Enzymatic Nucleic Acid
tattgaaaggctagctacaacgacaagacat

SEQ ID NO: 17871 - DNA, 31 bp, Artificial Sequence
  Description of Artificial Sequence:  Enzymatic Nucleic Acid
attaattaggctagctacaacgatgaaatca

SEQ ID NO: 17872 - DNA, 31 bp, Artificial Sequence
  Description of Artificial Sequence:  Enzymatic Nucleic Acid
agaattaaggctagctacaacgatattgaaa

SEQ ID NO: 17873 - DNA, 31 bp, Artificial Sequence
  Description of Artificial Sequence:  Enzymatic Nucleic Acid
attaagaaggctagctacaacgataattatt

SEQ ID NO: 17874 - DNA, 31 bp, Artificial Sequence
  Description of Artificial Sequence:  Enzymatic Nucleic Acid
cttaatgaggctagctacaacgataagaatt

SEQ ID NO: 17875 - DNA, 31 bp, Artificial Sequence
  Description of Artificial Sequence:  Enzymatic Nucleic Acid
tctcttaaggctagctacaacgagattaaga

SEQ ID NO: 17876 - DNA, 31 bp, Artificial Sequence
  Description of Artificial Sequence:  Enzymatic Nucleic Acid
tattatggggctagctacaacgactcttaat

SEQ ID NO: 17877 - DNA, 31 bp, Artificial Sequence
  Description of Artificial Sequence:  Enzymatic Nucleic Acid
atttattaggctagctacaacgaggtctctt

SEQ ID NO: 17878 - DNA, 31 bp, Artificial Sequence
  Description of Artificial Sequence:  Enzymatic Nucleic Acid
agtatttaggctagctacaacgatatggtct

SEQ ID NO: 17879 - DNA, 31 bp, Artificial Sequence
  Description of Artificial Sequence:  Enzymatic Nucleic Acid
aaggagtaggctagctacaacgattattatg

SEQ ID NO: 17880 - DNA, 31 bp, Artificial Sequence
  Description of Artificial Sequence:  Enzymatic Nucleic Acid
aaaaggagggctagctacaacgaatttatta

SEQ ID NO: 17881 - DNA, 31 bp, Artificial Sequence
  Description of Artificial Sequence:  Enzymatic Nucleic Acid
tggttttgggctagctacaacgattttctct

SEQ ID NO: 17882 - DNA, 31 bp, Artificial Sequence
  Description of Artificial Sequence:  Enzymatic Nucleic Acid
tctaatggggctagctacaacgatttgcttt

SEQ ID NO: 17883 - DNA, 31 bp, Artificial Sequence
  Description of Artificial Sequence:  Enzymatic Nucleic Acid
aattctaaggctagctacaacgaggttttgc

SEQ ID NO: 17884 - DNA, 31 bp, Artificial Sequence
  Description of Artificial Sequence:  Enzymatic Nucleic Acid
agtaacaaggctagctacaacgatctaatgg

SEQ ID NO: 17885 - DNA, 31 bp, Artificial Sequence
  Description of Artificial Sequence:  Enzymatic Nucleic Acid
ctgagtaaggctagctacaacgaaattctaa

SEQ ID NO: 17886 - DNA, 31 bp, Artificial Sequence
  Description of Artificial Sequence:  Enzymatic Nucleic Acid
gagctgagggctagctacaacgaaacaattc

SEQ ID NO: 17887 - DNA, 31 bp, Artificial Sequence
  Description of Artificial Sequence:  Enzymatic Nucleic Acid
tgaaggagggctagctacaacgatgagtaac

SEQ ID NO: 17888 - DNA, 31 bp, Artificial Sequence
  Description of Artificial Sequence:  Enzymatic Nucleic Acid
aacctgagggctagctacaacgattgaagga

SEQ ID NO: 17889 - DNA, 31 bp, Artificial Sequence
  Description of Artificial Sequence:  Enzymatic Nucleic Acid
gctacaaaggctagctacaacgactgagttt

SEQ ID NO: 17890 - DNA, 31 bp, Artificial Sequence
  Description of Artificial Sequence:  Enzymatic Nucleic Acid
gtatgctaggctagctacaacgaaaacctga

SEQ ID NO: 17891 - DNA, 31 bp, Artificial Sequence
  Description of Artificial Sequence:  Enzymatic Nucleic Acid
catgtatgggctagctacaacgatacaaacc

SEQ ID NO: 17892 - DNA, 31 bp, Artificial Sequence
  Description of Artificial Sequence:  Enzymatic Nucleic Acid
ctcatgtaggctagctacaacgagctacaaa

SEQ ID NO: 17893 - DNA, 31 bp, Artificial Sequence
  Description of Artificial Sequence:  Enzymatic Nucleic Acid
gactcatgggctagctacaacgaatgctaca

SEQ ID NO: 17894 - DNA, 31 bp, Artificial Sequence
  Description of Artificial Sequence:  Enzymatic Nucleic Acid
tggactcaggctagctacaacgagtatgcta

SEQ ID NO: 17895 - DNA, 31 bp, Artificial Sequence
  Description of Artificial Sequence:  Enzymatic Nucleic Acid
tggatggaggctagctacaacgatcatgtat

SEQ ID NO: 17896 - DNA, 31 bp, Artificial Sequence
  Description of Artificial Sequence:  Enzymatic Nucleic Acid
ctgatggaggctagctacaacgaggactcat

SEQ ID NO: 17897 - DNA, 31 bp, Artificial Sequence
  Description of Artificial Sequence:  Enzymatic Nucleic Acid
ttgactgaggctagctacaacgaggatggac

SEQ ID NO: 17898 - DNA, 31 bp, Artificial Sequence
  Description of Artificial Sequence:  Enzymatic Nucleic Acid
ttctttgaggctagctacaacgatgatggat

SEQ ID NO: 17899 - DNA, 31 bp, Artificial Sequence
  Description of Artificial Sequence:  Enzymatic Nucleic Acid
tggaaccaggctagctacaacgatctttgac

SEQ ID NO: 17900 - DNA, 31 bp, Artificial Sequence
  Description of Artificial Sequence:  Enzymatic Nucleic Acid
agatggaaggctagctacaacgacattcttt

SEQ ID NO: 17901 - DNA, 31 bp, Artificial Sequence
  Description of Artificial Sequence:  Enzymatic Nucleic Acid
actccagaggctagctacaacgaggaaccat

SEQ ID NO: 17902 - DNA, 31 bp, Artificial Sequence
  Description of Artificial Sequence:  Enzymatic Nucleic Acid
cattaagaggctagctacaacgatccagatg

SEQ ID NO: 17903 - DNA, 31 bp, Artificial Sequence
  Description of Artificial Sequence:  Enzymatic Nucleic Acid
tttctacaggctagctacaacgataagactc

SEQ ID NO: 17904 - DNA, 31 bp, Artificial Sequence
  Description of Artificial Sequence:  Enzymatic Nucleic Acid
tctttctaggctagctacaacgaattaagac

SEQ ID NO: 17905 - DNA, 31 bp, Artificial Sequence
  Description of Artificial Sequence:  Enzymatic Nucleic Acid
agtctccaggctagctacaacgattttcttt

SEQ ID NO: 17906 - DNA, 31 bp, Artificial Sequence
  Description of Artificial Sequence:  Enzymatic Nucleic Acid
attacaagggctagctacaacgactccattt

SEQ ID NO: 17907 - DNA, 31 bp, Artificial Sequence
  Description of Artificial Sequence:  Enzymatic Nucleic Acid
cattattaggctagctacaacgaaagtctcc

SEQ ID NO: 17908 - DNA, 31 bp, Artificial Sequence
  Description of Artificial Sequence:  Enzymatic Nucleic Acid
gctcattaggctagctacaacgatacaagtc

SEQ ID NO: 17909 - DNA, 31 bp, Artificial Sequence
  Description of Artificial Sequence:  Enzymatic Nucleic Acid
ctagctcaggctagctacaacgatattacaa

SEQ ID NO: 17910 - DNA, 31 bp, Artificial Sequence
  Description of Artificial Sequence:  Enzymatic Nucleic Acid
gtaactagggctagctacaacgatcattatt

SEQ ID NO: 17911 - DNA, 31 bp, Artificial Sequence
  Description of Artificial Sequence:  Enzymatic Nucleic Acid
ctttgtaaggctagctacaacgatagctcat

SEQ ID NO: 17912 - DNA, 31 bp, Artificial Sequence
  Description of Artificial Sequence:  Enzymatic Nucleic Acid
gcactttgggctagctacaacgaaactagct

SEQ ID NO: 17913 - DNA, 31 bp, Artificial Sequence
  Description of Artificial Sequence:  Enzymatic Nucleic Acid
aacaagcaggctagctacaacgatttgtaac

SEQ ID NO: 17914 - DNA, 31 bp, Artificial Sequence
  Description of Artificial Sequence:  Enzymatic Nucleic Acid
tgaacaagggctagctacaacgaactttgta

SEQ ID NO: 17915 - DNA, 31 bp, Artificial Sequence
  Description of Artificial Sequence:  Enzymatic Nucleic Acid
ttaatgaaggctagctacaacgaaagcactt

SEQ ID NO: 17916 - DNA, 31 bp, Artificial Sequence
  Description of Artificial Sequence:  Enzymatic Nucleic Acid
tattttaaggctagctacaacgagaacaagc

SEQ ID NO: 17917 - DNA, 31 bp, Artificial Sequence
  Description of Artificial Sequence:  Enzymatic Nucleic Acid
cagtgctaggctagctacaacgatttaatga

SEQ ID NO: 17918 - DNA, 31 bp, Artificial Sequence
  Description of Artificial Sequence:  Enzymatic Nucleic Acid
tttcagtgggctagctacaacgatattttaa

SEQ ID NO: 17919 - DNA, 31 bp, Artificial Sequence
  Description of Artificial Sequence:  Enzymatic Nucleic Acid
attttcagggctagctacaacgagctatttt

SEQ ID NO: 17920 - DNA, 31 bp, Artificial Sequence
  Description of Artificial Sequence:  Enzymatic Nucleic Acid
tgtttcaaggctagctacaacgatttcagtg

SEQ ID NO: 17921 - DNA, 31 bp, Artificial Sequence
  Description of Artificial Sequence:  Enzymatic Nucleic Acid
aattcatgggctagctacaacgattcaattt

SEQ ID NO: 17922 - DNA, 31 bp, Artificial Sequence
  Description of Artificial Sequence:  Enzymatic Nucleic Acid
ttaattcaggctagctacaacgagtttcaat

SEQ ID NO: 17923 - DNA, 31 bp, Artificial Sequence
  Description of Artificial Sequence:  Enzymatic Nucleic Acid
tcagttaaggctagctacaacgatcatgttt

SEQ ID NO: 17924 - DNA, 31 bp, Artificial Sequence
  Description of Artificial Sequence:  Enzymatic Nucleic Acid
attatcagggctagctacaacgataattcat

SEQ ID NO: 17925 - DNA, 31 bp, Artificial Sequence
  Description of Artificial Sequence:  Enzymatic Nucleic Acid
gaatattaggctagctacaacgacagttaat

SEQ ID NO: 17926 - DNA, 31 bp, Artificial Sequence
  Description of Artificial Sequence:  Enzymatic Nucleic Acid
ttggaataggctagctacaacgatatcagtt

SEQ ID NO: 17927 - DNA, 31 bp, Artificial Sequence
  Description of Artificial Sequence:  Enzymatic Nucleic Acid
gattggaaggctagctacaacgaattatcag

SEQ ID NO: 17928 - DNA, 31 bp, Artificial Sequence
  Description of Artificial Sequence:  Enzymatic Nucleic Acid
gcaaatgaggctagctacaacgatggaatat

SEQ ID NO: 17929 - DNA, 31 bp, Artificial Sequence
  Description of Artificial Sequence:  Enzymatic Nucleic Acid
atggcaaaggctagctacaacgagattggaa

SEQ ID NO: 17930 - DNA, 31 bp, Artificial Sequence
  Description of Artificial Sequence:  Enzymatic Nucleic Acid
ataaatggggctagctacaacgaaaatgatt

SEQ ID NO: 17931 - DNA, 31 bp, Artificial Sequence
  Description of Artificial Sequence:  Enzymatic Nucleic Acid
gtcataaaggctagctacaacgaggcaaatg

SEQ ID NO: 17932 - DNA, 31 bp, Artificial Sequence
  Description of Artificial Sequence:  Enzymatic Nucleic Acid
ttttgtcaggctagctacaacgaaaatggca

SEQ ID NO: 17933 - DNA, 31 bp, Artificial Sequence
  Description of Artificial Sequence:  Enzymatic Nucleic Acid
catttttgggctagctacaacgacataaatg

SEQ ID NO: 17934 - DNA, 31 bp, Artificial Sequence
  Description of Artificial Sequence:  Enzymatic Nucleic Acid
gccaaccaggctagctacaacgattttgtca

SEQ ID NO: 17935 - DNA, 31 bp, Artificial Sequence
  Description of Artificial Sequence:  Enzymatic Nucleic Acid
agtgccaaggctagctacaacgacatttttg

SEQ ID NO: 17936 - DNA, 31 bp, Artificial Sequence
  Description of Artificial Sequence:  Enzymatic Nucleic Acid
tgttagtgggctagctacaacgacaaccatt

SEQ ID NO: 17937 - DNA, 31 bp, Artificial Sequence
  Description of Artificial Sequence:  Enzymatic Nucleic Acid
tttgttagggctagctacaacgagccaacca

SEQ ID NO: 17938 - DNA, 31 bp, Artificial Sequence
  Description of Artificial Sequence:  Enzymatic Nucleic Acid
gttctttgggctagctacaacgatagtgcca

SEQ ID NO: 17939 - DNA, 31 bp, Artificial Sequence
  Description of Artificial Sequence:  Enzymatic Nucleic Acid
agtgctcgggctagctacaacgatctttgtt

SEQ ID NO: 17940 - DNA, 31 bp, Artificial Sequence
  Description of Artificial Sequence:  Enzymatic Nucleic Acid
aggaagtgggctagctacaacgatcgttctt

SEQ ID NO: 17941 - DNA, 31 bp, Artificial Sequence
  Description of Artificial Sequence:  Enzymatic Nucleic Acid
aaaggaagggctagctacaacgagctcgttc

SEQ ID NO: 17942 - DNA, 31 bp, Artificial Sequence
  Description of Artificial Sequence:  Enzymatic Nucleic Acid
ctcagaaaggctagctacaacgatctgaaag

SEQ ID NO: 17943 - DNA, 31 bp, Artificial Sequence
  Description of Artificial Sequence:  Enzymatic Nucleic Acid
gtacattaggctagctacaacgactcagaaa

SEQ ID NO: 17944 - DNA, 31 bp, Artificial Sequence
  Description of Artificial Sequence:  Enzymatic Nucleic Acid
cacgtacaggctagctacaacgatatctcag

SEQ ID NO: 17945 - DNA, 31 bp, Artificial Sequence
  Description of Artificial Sequence:  Enzymatic Nucleic Acid
tccacgtaggctagctacaacgaattatctc

SEQ ID NO: 17946 - DNA, 31 bp, Artificial Sequence
  Description of Artificial Sequence:  Enzymatic Nucleic Acid
gttccacgggctagctacaacgaacattatc

SEQ ID NO: 17947 - DNA, 31 bp, Artificial Sequence
  Description of Artificial Sequence:  Enzymatic Nucleic Acid
ctgttccaggctagctacaacgagtacatta

SEQ ID NO: 17948 - DNA, 31 bp, Artificial Sequence
  Description of Artificial Sequence:  Enzymatic Nucleic Acid
ccagactgggctagctacaacgatccacgta

SEQ ID NO: 17949 - DNA, 31 bp, Artificial Sequence
  Description of Artificial Sequence:  Enzymatic Nucleic Acid
cacccagaggctagctacaacgatgttccac

SEQ ID NO: 17950 - DNA, 31 bp, Artificial Sequence
  Description of Artificial Sequence:  Enzymatic Nucleic Acid
ccattccaggctagctacaacgaccagactg

SEQ ID NO: 17951 - DNA, 31 bp, Artificial Sequence
  Description of Artificial Sequence:  Enzymatic Nucleic Acid
cagccccaggctagctacaacgatccaccca

SEQ ID NO: 17952 - DNA, 31 bp, Artificial Sequence
  Description of Artificial Sequence:  Enzymatic Nucleic Acid
ggtttcagggctagctacaacgacccattcc

SEQ ID NO: 17953 - DNA, 31 bp, Artificial Sequence
  Description of Artificial Sequence:  Enzymatic Nucleic Acid
gcacatggggctagctacaacgattcagccc

SEQ ID NO: 17954 - DNA, 31 bp, Artificial Sequence
  Description of Artificial Sequence:  Enzymatic Nucleic Acid
cttgcacaggctagctacaacgaggtttcag

SEQ ID NO: 17955 - DNA, 31 bp, Artificial Sequence
  Description of Artificial Sequence:  Enzymatic Nucleic Acid
gacttgcaggctagctacaacgaatggtttc

SEQ ID NO: 17956 - DNA, 31 bp, Artificial Sequence
  Description of Artificial Sequence:  Enzymatic Nucleic Acid
cagacttgggctagctacaacgaacatggtt

SEQ ID NO: 17957 - DNA, 31 bp, Artificial Sequence
  Description of Artificial Sequence:  Enzymatic Nucleic Acid
gacacagaggctagctacaacgattgcacat

SEQ ID NO: 17958 - DNA, 31 bp, Artificial Sequence
  Description of Artificial Sequence:  Enzymatic Nucleic Acid
acaagacaggctagctacaacgaagacttgc

SEQ ID NO: 17959 - DNA, 31 bp, Artificial Sequence
  Description of Artificial Sequence:  Enzymatic Nucleic Acid
tgacaagaggctagctacaacgaacagactt

SEQ ID NO: 17960 - DNA, 31 bp, Artificial Sequence
  Description of Artificial Sequence:  Enzymatic Nucleic Acid
tggactgaggctagctacaacgaaagacaca

SEQ ID NO: 17961 - DNA, 31 bp, Artificial Sequence
  Description of Artificial Sequence:  Enzymatic Nucleic Acid
ttcttggaggctagctacaacgatgacaaga

SEQ ID NO: 17962 - DNA, 31 bp, Artificial Sequence
  Description of Artificial Sequence:  Enzymatic Nucleic Acid
cggtgtcaggctagctacaacgattcttgga

SEQ ID NO: 17963 - DNA, 31 bp, Artificial Sequence
  Description of Artificial Sequence:  Enzymatic Nucleic Acid
tctcggtgggctagctacaacgacacttctt

SEQ ID NO: 17964 - DNA, 31 bp, Artificial Sequence
  Description of Artificial Sequence:  Enzymatic Nucleic Acid
catctcggggctagctacaacgagtcacttc

SEQ ID NO: 17965 - DNA, 31 bp, Artificial Sequence
  Description of Artificial Sequence:  Enzymatic Nucleic Acid
aattaacaggctagctacaacgactcggtgt

SEQ ID NO: 17966 - DNA, 31 bp, Artificial Sequence
  Description of Artificial Sequence:  Enzymatic Nucleic Acid
aaaattaaggctagctacaacgaatctcggt

SEQ ID NO: 17967 - DNA, 31 bp, Artificial Sequence
  Description of Artificial Sequence:  Enzymatic Nucleic Acid
ccctaaaaggctagctacaacgataacatct

SEQ ID NO: 17968 - DNA, 31 bp, Artificial Sequence
  Description of Artificial Sequence:  Enzymatic Nucleic Acid
ggcacgggggctagctacaacgaccctaaaa

SEQ ID NO: 17969 - DNA, 31 bp, Artificial Sequence
  Description of Artificial Sequence:  Enzymatic Nucleic Acid
acaaggcaggctagctacaacgagggtccct

SEQ ID NO: 17970 - DNA, 31 bp, Artificial Sequence
  Description of Artificial Sequence:  Enzymatic Nucleic Acid
aaacaaggggctagctacaacgaacgggtcc

SEQ ID NO: 17971 - DNA, 31 bp, Artificial Sequence
  Description of Artificial Sequence:  Enzymatic Nucleic Acid
ctaggaaaggctagctacaacgaaaggcacg

SEQ ID NO: 17972 - DNA, 31 bp, Artificial Sequence
  Description of Artificial Sequence:  Enzymatic Nucleic Acid
cttgtgggggctagctacaacgataggaaac

SEQ ID NO: 17973 - DNA, 31 bp, Artificial Sequence
  Description of Artificial Sequence:  Enzymatic Nucleic Acid
cattcttgggctagctacaacgagggctagg

SEQ ID NO: 17974 - DNA, 31 bp, Artificial Sequence
  Description of Artificial Sequence:  Enzymatic Nucleic Acid
tgtttgcaggctagctacaacgatcttgtgg

SEQ ID NO: 17975 - DNA, 31 bp, Artificial Sequence
  Description of Artificial Sequence:  Enzymatic Nucleic Acid
gatgtttgggctagctacaacgaattcttgt

SEQ ID NO: 17976 - DNA, 31 bp, Artificial Sequence
  Description of Artificial Sequence:  Enzymatic Nucleic Acid
gtttgatgggctagctacaacgattgcattc

SEQ ID NO: 17977 - DNA, 31 bp, Artificial Sequence
  Description of Artificial Sequence:  Enzymatic Nucleic Acid
ctgtttgaggctagctacaacgagtttgcat

SEQ ID NO: 17978 - DNA, 31 bp, Artificial Sequence
  Description of Artificial Sequence:  Enzymatic Nucleic Acid
agtatctgggctagctacaacgattgatgtt

SEQ ID NO: 17979 - DNA, 31 bp, Artificial Sequence
  Description of Artificial Sequence:  Enzymatic Nucleic Acid
agcgagtaggctagctacaacgactgtttga

SEQ ID NO: 17980 - DNA, 31 bp, Artificial Sequence
  Description of Artificial Sequence:  Enzymatic Nucleic Acid
ctagcgagggctagctacaacgaatctgttt

SEQ ID NO: 17981 - DNA, 31 bp, Artificial Sequence
  Description of Artificial Sequence:  Enzymatic Nucleic Acid
gaggctagggctagctacaacgagagtatct

SEQ ID NO: 17982 - DNA, 31 bp, Artificial Sequence
  Description of Artificial Sequence:  Enzymatic Nucleic Acid
aaatgaggggctagctacaacgatagcgagt

SEQ ID NO: 17983 - DNA, 31 bp, Artificial Sequence
  Description of Artificial Sequence:  Enzymatic Nucleic Acid
aatttaaaggctagctacaacgagaggctag

SEQ ID NO: 17984 - DNA, 31 bp, Artificial Sequence
  Description of Artificial Sequence:  Enzymatic Nucleic Acid
ttaatcaaggctagctacaacgattaaatga

SEQ ID NO: 17985 - DNA, 31 bp, Artificial Sequence
  Description of Artificial Sequence:  Enzymatic Nucleic Acid
tcctttaaggctagctacaacgacaatttaa

SEQ ID NO: 17986 - DNA, 31 bp, Artificial Sequence
  Description of Artificial Sequence:  Enzymatic Nucleic Acid
aagatgcaggctagctacaacgatcctcctt

SEQ ID NO: 17987 - DNA, 31 bp, Artificial Sequence
  Description of Artificial Sequence:  Enzymatic Nucleic Acid
caaagatgggctagctacaacgaactcctcc

SEQ ID NO: 17988 - DNA, 31 bp, Artificial Sequence
  Description of Artificial Sequence:  Enzymatic Nucleic Acid
gccaaagaggctagctacaacgagcactcct

SEQ ID NO: 17989 - DNA, 31 bp, Artificial Sequence
  Description of Artificial Sequence:  Enzymatic Nucleic Acid
actgtcggggctagctacaacgacaaagatg

SEQ ID NO: 17990 - DNA, 31 bp, Artificial Sequence
  Description of Artificial Sequence:  Enzymatic Nucleic Acid
caccactgggctagctacaacgacggccaaa

SEQ ID NO: 17991 - DNA, 31 bp, Artificial Sequence
  Description of Artificial Sequence:  Enzymatic Nucleic Acid
ttacaccaggctagctacaacgatgtcggcc

SEQ ID NO: 17992 - DNA, 31 bp, Artificial Sequence
  Description of Artificial Sequence:  Enzymatic Nucleic Acid
cagttacaggctagctacaacgacactgtcg

SEQ ID NO: 17993 - DNA, 31 bp, Artificial Sequence
  Description of Artificial Sequence:  Enzymatic Nucleic Acid
cacagttaggctagctacaacgaaccactgt

SEQ ID NO: 17994 - DNA, 31 bp, Artificial Sequence
  Description of Artificial Sequence:  Enzymatic Nucleic Acid
acacacagggctagctacaacgatacaccac

SEQ ID NO: 17995 - DNA, 31 bp, Artificial Sequence
  Description of Artificial Sequence:  Enzymatic Nucleic Acid
cacacacaggctagctacaacgaagttacac

SEQ ID NO: 17996 - DNA, 31 bp, Artificial Sequence
  Description of Artificial Sequence:  Enzymatic Nucleic Acid
cacacacaggctagctacaacgaacagttac

SEQ ID NO: 17997 - DNA, 31 bp, Artificial Sequence
  Description of Artificial Sequence:  Enzymatic Nucleic Acid
cacacacaggctagctacaacgaacacagtt

SEQ ID NO: 17998 - DNA, 31 bp, Artificial Sequence
  Description of Artificial Sequence:  Enzymatic Nucleic Acid
cacacacaggctagctacaacgaacacacag

SEQ ID NO: 17999 - DNA, 31 bp, Artificial Sequence
  Description of Artificial Sequence:  Enzymatic Nucleic Acid
cacacacaggctagctacaacgaacacacac

SEQ ID NO: 18000 - DNA, 31 bp, Artificial Sequence
  Description of Artificial Sequence:  Enzymatic Nucleic Acid
cccacacaggctagctacaacgaacacacac

SEQ ID NO: 18001 - DNA, 31 bp, Artificial Sequence
  Description of Artificial Sequence:  Enzymatic Nucleic Acid
cacccacaggctagctacaacgaacacacac

SEQ ID NO: 18002 - DNA, 31 bp, Artificial Sequence
  Description of Artificial Sequence:  Enzymatic Nucleic Acid
cacacccaggctagctacaacgaacacacac

SEQ ID NO: 18003 - DNA, 31 bp, Artificial Sequence
  Description of Artificial Sequence:  Enzymatic Nucleic Acid
cacccacaggctagctacaacgaccacacac

SEQ ID NO: 18004 - DNA, 31 bp, Artificial Sequence
  Description of Artificial Sequence:  Enzymatic Nucleic Acid
tacacccaggctagctacaacgaacccacac

SEQ ID NO: 18005 - DNA, 31 bp, Artificial Sequence
  Description of Artificial Sequence:  Enzymatic Nucleic Acid
cacatacaggctagctacaacgaccacaccc

SEQ ID NO: 18006 - DNA, 31 bp, Artificial Sequence
  Description of Artificial Sequence:  Enzymatic Nucleic Acid
cacacataggctagctacaacgaacccacac

SEQ ID NO: 18007 - DNA, 31 bp, Artificial Sequence
  Description of Artificial Sequence:  Enzymatic Nucleic Acid
aacacacaggctagctacaacgaacacccac

SEQ ID NO: 18008 - DNA, 31 bp, Artificial Sequence
  Description of Artificial Sequence:  Enzymatic Nucleic Acid
aaaacacaggctagctacaacgaatacaccc

SEQ ID NO: 18009 - DNA, 31 bp, Artificial Sequence
  Description of Artificial Sequence:  Enzymatic Nucleic Acid
acaaaacaggctagctacaacgaacatacac

SEQ ID NO: 18010 - DNA, 31 bp, Artificial Sequence
  Description of Artificial Sequence:  Enzymatic Nucleic Acid
gcacaaaaggctagctacaacgaacacatac

SEQ ID NO: 18011 - DNA, 31 bp, Artificial Sequence
  Description of Artificial Sequence:  Enzymatic Nucleic Acid
gttatgcaggctagctacaacgaaaaacaca

SEQ ID NO: 18012 - DNA, 31 bp, Artificial Sequence
  Description of Artificial Sequence:  Enzymatic Nucleic Acid
tagttatgggctagctacaacgaacaaaaca

SEQ ID NO: 18013 - DNA, 31 bp, Artificial Sequence
  Description of Artificial Sequence:  Enzymatic Nucleic Acid
aatagttaggctagctacaacgagcacaaaa

SEQ ID NO: 18014 - DNA, 31 bp, Artificial Sequence
  Description of Artificial Sequence:  Enzymatic Nucleic Acid
ttaaatagggctagctacaacgatatgcaca

SEQ ID NO: 18015 - DNA, 31 bp, Artificial Sequence
  Description of Artificial Sequence:  Enzymatic Nucleic Acid
tccttaaaggctagctacaacgaagttatgc

SEQ ID NO: 18016 - DNA, 31 bp, Artificial Sequence
  Description of Artificial Sequence:  Enzymatic Nucleic Acid
aattccagggctagctacaacgattccttaa

SEQ ID NO: 18017 - DNA, 31 bp, Artificial Sequence
  Description of Artificial Sequence:  Enzymatic Nucleic Acid
ctttaaaaggctagctacaacgatccagttt

SEQ ID NO: 18018 - DNA, 31 bp, Artificial Sequence
  Description of Artificial Sequence:  Enzymatic Nucleic Acid
aaaagtaaggctagctacaacgatttaaaat

SEQ ID NO: 18019 - DNA, 31 bp, Artificial Sequence
  Description of Artificial Sequence:  Enzymatic Nucleic Acid
tataaaagggctagctacaacgaaactttaa

SEQ ID NO: 18020 - DNA, 31 bp, Artificial Sequence
  Description of Artificial Sequence:  Enzymatic Nucleic Acid
ggtttgtaggctagctacaacgaaaaagtaa

SEQ ID NO: 18021 - DNA, 31 bp, Artificial Sequence
  Description of Artificial Sequence:  Enzymatic Nucleic Acid
ttggtttgggctagctacaacgaataaaagt

SEQ ID NO: 18022 - DNA, 31 bp, Artificial Sequence
  Description of Artificial Sequence:  Enzymatic Nucleic Acid
attcttggggctagctacaacgattgtataa

SEQ ID NO: 18023 - DNA, 31 bp, Artificial Sequence
  Description of Artificial Sequence:  Enzymatic Nucleic Acid
agcatataggctagctacaacgatcttggtt

SEQ ID NO: 18024 - DNA, 31 bp, Artificial Sequence
  Description of Artificial Sequence:  Enzymatic Nucleic Acid
gtagcataggctagctacaacgaattcttgg

SEQ ID NO: 18025 - DNA, 31 bp, Artificial Sequence
  Description of Artificial Sequence:  Enzymatic Nucleic Acid
ctgtagcaggctagctacaacgaatattctt

SEQ ID NO: 18026 - DNA, 31 bp, Artificial Sequence
  Description of Artificial Sequence:  Enzymatic Nucleic Acid
atctgtagggctagctacaacgaatatattc

SEQ ID NO: 18027 - DNA, 31 bp, Artificial Sequence
  Description of Artificial Sequence:  Enzymatic Nucleic Acid
tatatctgggctagctacaacgaagcatata

SEQ ID NO: 18028 - DNA, 31 bp, Artificial Sequence
  Description of Artificial Sequence:  Enzymatic Nucleic Acid
gtcttataggctagctacaacgactgtagca

SEQ ID NO: 18029 - DNA, 31 bp, Artificial Sequence
  Description of Artificial Sequence:  Enzymatic Nucleic Acid
ctgtcttaggctagctacaacgaatctgtag

SEQ ID NO: 18030 - DNA, 31 bp, Artificial Sequence
  Description of Artificial Sequence:  Enzymatic Nucleic Acid
catgtctgggctagctacaacgacttatatc

SEQ ID NO: 18031 - DNA, 31 bp, Artificial Sequence
  Description of Artificial Sequence:  Enzymatic Nucleic Acid
aaaccatgggctagctacaacgactgtctta

SEQ ID NO: 18032 - DNA, 31 bp, Artificial Sequence
  Description of Artificial Sequence:  Enzymatic Nucleic Acid
ccaaaccaggctagctacaacgagtctgtct

SEQ ID NO: 18033 - DNA, 31 bp, Artificial Sequence
  Description of Artificial Sequence:  Enzymatic Nucleic Acid
ggaccaaaggctagctacaacgacatgtctg

SEQ ID NO: 18034 - DNA, 31 bp, Artificial Sequence
  Description of Artificial Sequence:  Enzymatic Nucleic Acid
atataggaggctagctacaacgacaaaccat

SEQ ID NO: 18035 - DNA, 31 bp, Artificial Sequence
  Description of Artificial Sequence:  Enzymatic Nucleic Acid
tagaaataggctagctacaacgaaggaccaa

SEQ ID NO: 18036 - DNA, 31 bp, Artificial Sequence
  Description of Artificial Sequence:  Enzymatic Nucleic Acid
actagaaaggctagctacaacgaataggacc

SEQ ID NO: 18037 - DNA, 31 bp, Artificial Sequence
  Description of Artificial Sequence:  Enzymatic Nucleic Acid
catcatgaggctagctacaacgatagaaata

SEQ ID NO: 18038 - DNA, 31 bp, Artificial Sequence
  Description of Artificial Sequence:  Enzymatic Nucleic Acid
attcatcaggctagctacaacgagactagaa

SEQ ID NO: 18039 - DNA, 31 bp, Artificial Sequence
  Description of Artificial Sequence:  Enzymatic Nucleic Acid
tacattcaggctagctacaacgacatgacta

SEQ ID NO: 18040 - DNA, 31 bp, Artificial Sequence
  Description of Artificial Sequence:  Enzymatic Nucleic Acid
aaaatacaggctagctacaacgatcatcatg

SEQ ID NO: 18041 - DNA, 31 bp, Artificial Sequence
  Description of Artificial Sequence:  Enzymatic Nucleic Acid
acaaaataggctagctacaacgaattcatca

SEQ ID NO: 18042 - DNA, 31 bp, Artificial Sequence
  Description of Artificial Sequence:  Enzymatic Nucleic Acid
atacaaaaggctagctacaacgaacattcat

SEQ ID NO: 18043 - DNA, 31 bp, Artificial Sequence
  Description of Artificial Sequence:  Enzymatic Nucleic Acid
atggtataggctagctacaacgaaaaataca

SEQ ID NO: 18044 - DNA, 31 bp, Artificial Sequence
  Description of Artificial Sequence:  Enzymatic Nucleic Acid
agatggtaggctagctacaacgaacaaaata

SEQ ID NO: 18045 - DNA, 31 bp, Artificial Sequence
  Description of Artificial Sequence:  Enzymatic Nucleic Acid
gaagatggggctagctacaacgaatacaaaa

SEQ ID NO: 18046 - DNA, 31 bp, Artificial Sequence
  Description of Artificial Sequence:  Enzymatic Nucleic Acid
tatgaagaggctagctacaacgaggtataca

SEQ ID NO: 18047 - DNA, 31 bp, Artificial Sequence
  Description of Artificial Sequence:  Enzymatic Nucleic Acid
atattataggctagctacaacgagaagatgg

SEQ ID NO: 18048 - DNA, 31 bp, Artificial Sequence
  Description of Artificial Sequence:  Enzymatic Nucleic Acid
gtatattaggctagctacaacgaatgaagat

SEQ ID NO: 18049 - DNA, 31 bp, Artificial Sequence
  Description of Artificial Sequence:  Enzymatic Nucleic Acid
taagtataggctagctacaacgatatatgaa

SEQ ID NO: 18050 - DNA, 31 bp, Artificial Sequence
  Description of Artificial Sequence:  Enzymatic Nucleic Acid
tttaagtaggctagctacaacgaattatatg

SEQ ID NO: 18051 - DNA, 31 bp, Artificial Sequence
  Description of Artificial Sequence:  Enzymatic Nucleic Acid
tttttaagggctagctacaacgaatattata

SEQ ID NO: 18052 - DNA, 31 bp, Artificial Sequence
  Description of Artificial Sequence:  Enzymatic Nucleic Acid
aagaaataggctagctacaacgattttaagt

SEQ ID NO: 18053 - DNA, 31 bp, Artificial Sequence
  Description of Artificial Sequence:  Enzymatic Nucleic Acid
ttaagaaaggctagctacaacgaatttttaa

SEQ ID NO: 18054 - DNA, 31 bp, Artificial Sequence
  Description of Artificial Sequence:  Enzymatic Nucleic Acid
aatcccaaggctagctacaacgataagaaat

SEQ ID NO: 18055 - DNA, 31 bp, Artificial Sequence
  Description of Artificial Sequence:  Enzymatic Nucleic Acid
attacaaaggctagctacaacgacccaatta

SEQ ID NO: 18056 - DNA, 31 bp, Artificial Sequence
  Description of Artificial Sequence:  Enzymatic Nucleic Acid
tacgattaggctagctacaacgaaaatccca

SEQ ID NO: 18057 - DNA, 31 bp, Artificial Sequence
  Description of Artificial Sequence:  Enzymatic Nucleic Acid
tggtacgaggctagctacaacgatacaaatc

SEQ ID NO: 18058 - DNA, 31 bp, Artificial Sequence
  Description of Artificial Sequence:  Enzymatic Nucleic Acid
agttggtaggctagctacaacgagattacaa

SEQ ID NO: 18059 - DNA, 31 bp, Artificial Sequence
  Description of Artificial Sequence:  Enzymatic Nucleic Acid
taagttggggctagctacaacgaacgattac

SEQ ID NO: 18060 - DNA, 31 bp, Artificial Sequence
  Description of Artificial Sequence:  Enzymatic Nucleic Acid
caattaagggctagctacaacgatggtacga

SEQ ID NO: 18061 - DNA, 31 bp, Artificial Sequence
  Description of Artificial Sequence:  Enzymatic Nucleic Acid
tttatcaaggctagctacaacgataagttgg

SEQ ID NO: 18062 - DNA, 31 bp, Artificial Sequence
  Description of Artificial Sequence:  Enzymatic Nucleic Acid
caagtttaggctagctacaacgacaattaag

SEQ ID NO: 18063 - DNA, 31 bp, Artificial Sequence
  Description of Artificial Sequence:  Enzymatic Nucleic Acid
ttgccaagggctagctacaacgattatcaat

SEQ ID NO: 18064 - DNA, 31 bp, Artificial Sequence
  Description of Artificial Sequence:  Enzymatic Nucleic Acid
agcagttgggctagctacaacgacaagttta

SEQ ID NO: 18065 - DNA, 31 bp, Artificial Sequence
  Description of Artificial Sequence:  Enzymatic Nucleic Acid
aaaagcagggctagctacaacgatgccaagt

SEQ ID NO: 18066 - DNA, 31 bp, Artificial Sequence
  Description of Artificial Sequence:  Enzymatic Nucleic Acid
cataaaagggctagctacaacgaagttgcca

SEQ ID NO: 18067 - DNA, 31 bp, Artificial Sequence
  Description of Artificial Sequence:  Enzymatic Nucleic Acid
acagaacaggctagctacaacgaaaaagcag

SEQ ID NO: 18068 - DNA, 31 bp, Artificial Sequence
  Description of Artificial Sequence:  Enzymatic Nucleic Acid
agacagaaggctagctacaacgaataaaagc

SEQ ID NO: 18069 - DNA, 31 bp, Artificial Sequence
  Description of Artificial Sequence:  Enzymatic Nucleic Acid
gaaggagaggctagctacaacgaagaacata

SEQ ID NO: 18070 - DNA, 31 bp, Artificial Sequence
  Description of Artificial Sequence:  Enzymatic Nucleic Acid
aaaatttaggctagctacaacgaggaaggag

SEQ ID NO: 18071 - DNA, 31 bp, Artificial Sequence
  Description of Artificial Sequence:  Enzymatic Nucleic Acid
ttgaaaaaggctagctacaacgattatggaa

SEQ ID NO: 18072 - DNA, 31 bp, Artificial Sequence
  Description of Artificial Sequence:  Enzymatic Nucleic Acid
aattagtaggctagctacaacgatttgaaaa

SEQ ID NO: 18073 - DNA, 31 bp, Artificial Sequence
  Description of Artificial Sequence:  Enzymatic Nucleic Acid
tgaattagggctagctacaacgaattttgaa

SEQ ID NO: 18074 - DNA, 31 bp, Artificial Sequence
  Description of Artificial Sequence:  Enzymatic Nucleic Acid
ttgttgaaggctagctacaacgatagtattt

SEQ ID NO: 18075 - DNA, 31 bp, Artificial Sequence
  Description of Artificial Sequence:  Enzymatic Nucleic Acid
tttctttgggctagctacaacgatgaattag

SEQ ID NO: 18076 - DNA, 31 bp, Artificial Sequence
  Description of Artificial Sequence:  Enzymatic Nucleic Acid
aaaaagagggctagctacaacgatttttctt

SEQ ID NO: 18077 - DNA, 31 bp, Artificial Sequence
  Description of Artificial Sequence:  Enzymatic Nucleic Acid
tgagtttaggctagctacaacgatttaggaa

SEQ ID NO: 18078 - DNA, 31 bp, Artificial Sequence
  Description of Artificial Sequence:  Enzymatic Nucleic Acid
aatttgagggctagctacaacgattatttta

SEQ ID NO: 18079 - DNA, 31 bp, Artificial Sequence
  Description of Artificial Sequence:  Enzymatic Nucleic Acid
aggataaaggctagctacaacgattgagttt

SEQ ID NO: 18080 - DNA, 31 bp, Artificial Sequence
  Description of Artificial Sequence:  Enzymatic Nucleic Acid
aacaaggaggctagctacaacgaaaatttga

SEQ ID NO: 18081 - DNA, 31 bp, Artificial Sequence
  Description of Artificial Sequence:  Enzymatic Nucleic Acid
gctctaaaggctagctacaacgaaaggataa

SEQ ID NO: 18082 - DNA, 31 bp, Artificial Sequence
  Description of Artificial Sequence:  Enzymatic Nucleic Acid
tttctctgggctagctacaacgatctaaaca

SEQ ID NO: 18083 - DNA, 31 bp, Artificial Sequence
  Description of Artificial Sequence:  Enzymatic Nucleic Acid
tttcttaaggctagctacaacgattttctct

SEQ ID NO: 18084 - DNA, 31 bp, Artificial Sequence
  Description of Artificial Sequence:  Enzymatic Nucleic Acid
tttcaaagggctagctacaacgattttctta

SEQ ID NO: 18085 - DNA, 31 bp, Artificial Sequence
  Description of Artificial Sequence:  Enzymatic Nucleic Acid
tgagaccaggctagctacaacgattcaaagt

SEQ ID NO: 18086 - DNA, 31 bp, Artificial Sequence
  Description of Artificial Sequence:  Enzymatic Nucleic Acid
ttttgagaggctagctacaacgacatttcaa

SEQ ID NO: 18087 - DNA, 31 bp, Artificial Sequence
  Description of Artificial Sequence:  Enzymatic Nucleic Acid
tttagcaaggctagctacaacgatttttgag

SEQ ID NO: 18088 - DNA, 31 bp, Artificial Sequence
  Description of Artificial Sequence:  Enzymatic Nucleic Acid
atatttagggctagctacaacgaaatttttt

SEQ ID NO: 18089 - DNA, 31 bp, Artificial Sequence
  Description of Artificial Sequence:  Enzymatic Nucleic Acid
tgaaaataggctagctacaacgattagcaat

SEQ ID NO: 18090 - DNA, 31 bp, Artificial Sequence
  Description of Artificial Sequence:  Enzymatic Nucleic Acid
attgaaaaggctagctacaacgaatttagca

SEQ ID NO: 18091 - DNA, 31 bp, Artificial Sequence
  Description of Artificial Sequence:  Enzymatic Nucleic Acid
gttttccaggctagctacaacgatgaaaata

SEQ ID NO: 18092 - DNA, 31 bp, Artificial Sequence
  Description of Artificial Sequence:  Enzymatic Nucleic Acid
acatttagggctagctacaacgatttccatt

SEQ ID NO: 18093 - DNA, 31 bp, Artificial Sequence
  Description of Artificial Sequence:  Enzymatic Nucleic Acid
aactaacaggctagctacaacgattagtttt

SEQ ID NO: 18094 - DNA, 31 bp, Artificial Sequence
  Description of Artificial Sequence:  Enzymatic Nucleic Acid
taaactaaggctagctacaacgaatttagtt

SEQ ID NO: 18095 - DNA, 31 bp, Artificial Sequence
  Description of Artificial Sequence:  Enzymatic Nucleic Acid
cagctaaaggctagctacaacgataacattt

SEQ ID NO: 18096 - DNA, 31 bp, Artificial Sequence
  Description of Artificial Sequence:  Enzymatic Nucleic Acid
acaatcagggctagctacaacgataaactaa

SEQ ID NO: 18097 - DNA, 31 bp, Artificial Sequence
  Description of Artificial Sequence:  Enzymatic Nucleic Acid
ccatacaaggctagctacaacgacagctaaa

SEQ ID NO: 18098 - DNA, 31 bp, Artificial Sequence
  Description of Artificial Sequence:  Enzymatic Nucleic Acid
accccataggctagctacaacgaaatcagct

SEQ ID NO: 18099 - DNA, 31 bp, Artificial Sequence
  Description of Artificial Sequence:  Enzymatic Nucleic Acid
aaaccccaggctagctacaacgaacaatcag

SEQ ID NO: 18100 - DNA, 31 bp, Artificial Sequence
  Description of Artificial Sequence:  Enzymatic Nucleic Acid
ttcgaaaaggctagctacaacgacccataca

SEQ ID NO: 18101 - DNA, 31 bp, Artificial Sequence
  Description of Artificial Sequence:  Enzymatic Nucleic Acid
gtgaaaggggctagctacaacgatcgaaaac

SEQ ID NO: 18102 - DNA, 31 bp, Artificial Sequence
  Description of Artificial Sequence:  Enzymatic Nucleic Acid
acaaaaagggctagctacaacgagaaaggtt

SEQ ID NO: 18103 - DNA, 31 bp, Artificial Sequence
  Description of Artificial Sequence:  Enzymatic Nucleic Acid
aaaacaaaggctagctacaacgaaaaaagtg

SEQ ID NO: 18104 - DNA, 31 bp, Artificial Sequence
  Description of Artificial Sequence:  Enzymatic Nucleic Acid
aggtaaaaggctagctacaacgaaaacaaaa

SEQ ID NO: 18105 - DNA, 31 bp, Artificial Sequence
  Description of Artificial Sequence:  Enzymatic Nucleic Acid
gaaataggggctagctacaacgaaaaacaaa

SEQ ID NO: 18106 - DNA, 31 bp, Artificial Sequence
  Description of Artificial Sequence:  Enzymatic Nucleic Acid
ttgtgaaaggctagctacaacgaaggtaaaa

SEQ ID NO: 18107 - DNA, 31 bp, Artificial Sequence
  Description of Artificial Sequence:  Enzymatic Nucleic Acid
cacagttgggctagctacaacgagaaatagg

SEQ ID NO: 18108 - DNA, 31 bp, Artificial Sequence
  Description of Artificial Sequence:  Enzymatic Nucleic Acid
ttacacagggctagctacaacgatgtgaaat

SEQ ID NO: 18109 - DNA, 31 bp, Artificial Sequence
  Description of Artificial Sequence:  Enzymatic Nucleic Acid
aatttacaggctagctacaacgaagttgtga

SEQ ID NO: 18110 - DNA, 31 bp, Artificial Sequence
  Description of Artificial Sequence:  Enzymatic Nucleic Acid
gcaatttaggctagctacaacgaacagttgt

SEQ ID NO: 18111 - DNA, 31 bp, Artificial Sequence
  Description of Artificial Sequence:  Enzymatic Nucleic Acid
attggcaaggctagctacaacgattacacag

SEQ ID NO: 18112 - DNA, 31 bp, Artificial Sequence
  Description of Artificial Sequence:  Enzymatic Nucleic Acid
attattggggctagctacaacgaaatttaca

SEQ ID NO: 18113 - DNA, 31 bp, Artificial Sequence
  Description of Artificial Sequence:  Enzymatic Nucleic Acid
aggaattaggctagctacaacgatggcaatt

SEQ ID NO: 18114 - DNA, 31 bp, Artificial Sequence
  Description of Artificial Sequence:  Enzymatic Nucleic Acid
gacaggaaggctagctacaacgatattggca

SEQ ID NO: 18115 - DNA, 31 bp, Artificial Sequence
  Description of Artificial Sequence:  Enzymatic Nucleic Acid
ttcatggaggctagctacaacgaaggaatta

SEQ ID NO: 18116 - DNA, 31 bp, Artificial Sequence
  Description of Artificial Sequence:  Enzymatic Nucleic Acid
cattttcaggctagctacaacgaggacagga

SEQ ID NO: 18117 - DNA, 31 bp, Artificial Sequence
  Description of Artificial Sequence:  Enzymatic Nucleic Acid
aatttgcaggctagctacaacgatttcatgg

SEQ ID NO: 18118 - DNA, 31 bp, Artificial Sequence
  Description of Artificial Sequence:  Enzymatic Nucleic Acid
ataatttgggctagctacaacgaattttcat

SEQ ID NO: 18119 - DNA, 31 bp, Artificial Sequence
  Description of Artificial Sequence:  Enzymatic Nucleic Acid
ctggataaggctagctacaacgattgcattt

SEQ ID NO: 18120 - DNA, 31 bp, Artificial Sequence
  Description of Artificial Sequence:  Enzymatic Nucleic Acid
acactggaggctagctacaacgaaatttgca

SEQ ID NO: 18121 - DNA, 31 bp, Artificial Sequence
  Description of Artificial Sequence:  Enzymatic Nucleic Acid
tatctacaggctagctacaacgatggataat

SEQ ID NO: 18122 - DNA, 31 bp, Artificial Sequence
  Description of Artificial Sequence:  Enzymatic Nucleic Acid
tatatctaggctagctacaacgaactggata

SEQ ID NO: 18123 - DNA, 31 bp, Artificial Sequence
  Description of Artificial Sequence:  Enzymatic Nucleic Acid
caaatataggctagctacaacgactacactg

SEQ ID NO: 18124 - DNA, 31 bp, Artificial Sequence
  Description of Artificial Sequence:  Enzymatic Nucleic Acid
gtcaaataggctagctacaacgaatctacac

SEQ ID NO: 18125 - DNA, 31 bp, Artificial Sequence
  Description of Artificial Sequence:  Enzymatic Nucleic Acid
tggtcaaaggctagctacaacgaatatctac

SEQ ID NO: 18126 - DNA, 31 bp, Artificial Sequence
  Description of Artificial Sequence:  Enzymatic Nucleic Acid
ggtgatggggctagctacaacgacaaatata

SEQ ID NO: 18127 - DNA, 31 bp, Artificial Sequence
  Description of Artificial Sequence:  Enzymatic Nucleic Acid
tagggtgaggctagctacaacgaggtcaaat

SEQ ID NO: 18128 - DNA, 31 bp, Artificial Sequence
  Description of Artificial Sequence:  Enzymatic Nucleic Acid
ccatagggggctagctacaacgagatggtca

SEQ ID NO: 18129 - DNA, 31 bp, Artificial Sequence
  Description of Artificial Sequence:  Enzymatic Nucleic Acid
aatatccaggctagctacaacgaagggtgat

SEQ ID NO: 18130 - DNA, 31 bp, Artificial Sequence
  Description of Artificial Sequence:  Enzymatic Nucleic Acid
agccaataggctagctacaacgaccataggg

SEQ ID NO: 18131 - DNA, 31 bp, Artificial Sequence
  Description of Artificial Sequence:  Enzymatic Nucleic Acid
ctagccaaggctagctacaacgaatccatag

SEQ ID NO: 18132 - DNA, 31 bp, Artificial Sequence
  Description of Artificial Sequence:  Enzymatic Nucleic Acid
aaaactagggctagctacaacgacaatatcc

SEQ ID NO: 18133 - DNA, 31 bp, Artificial Sequence
  Description of Artificial Sequence:  Enzymatic Nucleic Acid
aggcaaaaggctagctacaacgatagccaat

SEQ ID NO: 18134 - DNA, 31 bp, Artificial Sequence
  Description of Artificial Sequence:  Enzymatic Nucleic Acid
aataaaggggctagctacaacgaaaaactag

SEQ ID NO: 18135 - DNA, 31 bp, Artificial Sequence
  Description of Artificial Sequence:  Enzymatic Nucleic Acid
ttgcttaaggctagctacaacgaaaaggcaa

SEQ ID NO: 18136 - DNA, 31 bp, Artificial Sequence
  Description of Artificial Sequence:  Enzymatic Nucleic Acid
tgaatttgggctagctacaacgattaataaa

SEQ ID NO: 18137 - DNA, 31 bp, Artificial Sequence
  Description of Artificial Sequence:  Enzymatic Nucleic Acid
gaaatgaaggctagctacaacgattgcttaa

SEQ ID NO: 18138 - DNA, 31 bp, Artificial Sequence
  Description of Artificial Sequence:  Enzymatic Nucleic Acid
ggctgaaaggctagctacaacgagaatttgc

SEQ ID NO: 18139 - DNA, 31 bp, Artificial Sequence
  Description of Artificial Sequence:  Enzymatic Nucleic Acid
cattcaggggctagctacaacgatgaaatga

SEQ ID NO: 18140 - DNA, 31 bp, Artificial Sequence
  Description of Artificial Sequence:  Enzymatic Nucleic Acid
ggcagacaggctagctacaacgatcaggctg

SEQ ID NO: 18141 - DNA, 31 bp, Artificial Sequence
  Description of Artificial Sequence:  Enzymatic Nucleic Acid
taggcagaggctagctacaacgaattcaggc

SEQ ID NO: 18142 - DNA, 31 bp, Artificial Sequence
  Description of Artificial Sequence:  Enzymatic Nucleic Acid
tatataggggctagctacaacgaagacattc

SEQ ID NO: 18143 - DNA, 31 bp, Artificial Sequence
  Description of Artificial Sequence:  Enzymatic Nucleic Acid
agaatataggctagctacaacgaaggcagac

SEQ ID NO: 18144 - DNA, 31 bp, Artificial Sequence
  Description of Artificial Sequence:  Enzymatic Nucleic Acid
agagaataggctagctacaacgaataggcag

SEQ ID NO: 18145 - DNA, 31 bp, Artificial Sequence
  Description of Artificial Sequence:  Enzymatic Nucleic Acid
gcagagaaggctagctacaacgaatataggc

SEQ ID NO: 18146 - DNA, 31 bp, Artificial Sequence
  Description of Artificial Sequence:  Enzymatic Nucleic Acid
acaaagagggctagctacaacgaagagaata

SEQ ID NO: 18147 - DNA, 31 bp, Artificial Sequence
  Description of Artificial Sequence:  Enzymatic Nucleic Acid
ggagaataggctagctacaacgaaaagagca

SEQ ID NO: 18148 - DNA, 31 bp, Artificial Sequence
  Description of Artificial Sequence:  Enzymatic Nucleic Acid
aaggagaaggctagctacaacgaacaaagag

SEQ ID NO: 18149 - DNA, 31 bp, Artificial Sequence
  Description of Artificial Sequence:  Enzymatic Nucleic Acid
ttaacgggggctagctacaacgatcaaagga

SEQ ID NO: 18150 - DNA, 31 bp, Artificial Sequence
  Description of Artificial Sequence:  Enzymatic Nucleic Acid
tgttttaaggctagctacaacgagggttcaa

SEQ ID NO: 18151 - DNA, 31 bp, Artificial Sequence
  Description of Artificial Sequence:  Enzymatic Nucleic Acid
acaggatgggctagctacaacgatttaacgg

SEQ ID NO: 18152 - DNA, 31 bp, Artificial Sequence
  Description of Artificial Sequence:  Enzymatic Nucleic Acid
ccacaggaggctagctacaacgagttttaac

SEQ ID NO: 18153 - DNA, 31 bp, Artificial Sequence
  Description of Artificial Sequence:  Enzymatic Nucleic Acid
gagtgccaggctagctacaacgaaggatgtt

SEQ ID NO: 18154 - RNA, 37 nt, Artificial Sequence
  Description of Artificial Sequence:  Enzymatic Nucleic Acid
gggaggaggccgaaaggcgagugaggucucgagagga

SEQ ID NO: 18155 - RNA, 37 nt, Artificial Sequence
  Description of Artificial Sequence:  Enzymatic Nucleic Acid
cgccgcuggccgaaaggcgagugaggucucggggagg

SEQ ID NO: 18156 - RNA, 37 nt, Artificial Sequence
  Description of Artificial Sequence:  Enzymatic Nucleic Acid
cgccgccggccgaaaggcgagugaggucuugccgggg

SEQ ID NO: 18157 - RNA, 37 nt, Artificial Sequence
  Description of Artificial Sequence:  Enzymatic Nucleic Acid
agccgccggccgaaaggcgagugaggucucgcugccg

SEQ ID NO: 18158 - RNA, 37 nt, Artificial Sequence
  Description of Artificial Sequence:  Enzymatic Nucleic Acid
ccgagccggccgaaaggcgagugaggucucgccgcug

SEQ ID NO: 18159 - RNA, 37 nt, Artificial Sequence
  Description of Artificial Sequence:  Enzymatic Nucleic Acid
gcuccgaggccgaaaggcgagugaggucucgccgccg

SEQ ID NO: 18160 - RNA, 37 nt, Artificial Sequence
  Description of Artificial Sequence:  Enzymatic Nucleic Acid
ggagcccggccgaaaggcgagugaggucuuccgagcc

SEQ ID NO: 18161 - RNA, 37 nt, Artificial Sequence
  Description of Artificial Sequence:  Enzymatic Nucleic Acid
ccccggaggccgaaaggcgagugaggucuccgcuccg

SEQ ID NO: 18162 - RNA, 37 nt, Artificial Sequence
  Description of Artificial Sequence:  Enzymatic Nucleic Acid
cacccgaggccgaaaggcgagugaggucucccggagc

SEQ ID NO: 18163 - RNA, 37 nt, Artificial Sequence
  Description of Artificial Sequence:  Enzymatic Nucleic Acid
ccgcugcagccgaaaggcgagugaggucuccgagccc

SEQ ID NO: 18164 - RNA, 37 nt, Artificial Sequence
  Description of Artificial Sequence:  Enzymatic Nucleic Acid
ggccgcuggccgaaaggcgagugaggucuacccgagc

SEQ ID NO: 18165 - RNA, 37 nt, Artificial Sequence
  Description of Artificial Sequence:  Enzymatic Nucleic Acid
gcuggccggccgaaaggcgagugaggucuugcacccg

SEQ ID NO: 18166 - RNA, 37 nt, Artificial Sequence
  Description of Artificial Sequence:  Enzymatic Nucleic Acid
cccgcugggccgaaaggcgagugaggucucgcugcac

SEQ ID NO: 18167 - RNA, 37 nt, Artificial Sequence
  Description of Artificial Sequence:  Enzymatic Nucleic Acid
caggcccggccgaaaggcgagugaggucuuggccgcu

SEQ ID NO: 18168 - RNA, 37 nt, Artificial Sequence
  Description of Artificial Sequence:  Enzymatic Nucleic Acid
ccgccagggccgaaaggcgagugaggucuccgcuggc

SEQ ID NO: 18169 - RNA, 37 nt, Artificial Sequence
  Description of Artificial Sequence:  Enzymatic Nucleic Acid
ccucgccggccgaaaggcgagugaggucucaggcccg

SEQ ID NO: 18170 - RNA, 37 nt, Artificial Sequence
  Description of Artificial Sequence:  Enzymatic Nucleic Acid
aauccucggccgaaaggcgagugaggucucgccaggc

SEQ ID NO: 18171 - RNA, 37 nt, Artificial Sequence
  Description of Artificial Sequence:  Enzymatic Nucleic Acid
gacaaccagccgaaaggcgagugaggucuuuccccgg

SEQ ID NO: 18172 - RNA, 37 nt, Artificial Sequence
  Description of Artificial Sequence:  Enzymatic Nucleic Acid
ggagacaagccgaaaggcgagugaggucucacuuccc

SEQ ID NO: 18173 - RNA, 37 nt, Artificial Sequence
  Description of Artificial Sequence:  Enzymatic Nucleic Acid
ccaggagagccgaaaggcgagugaggucuaaccacuu

SEQ ID NO: 18174 - RNA, 37 nt, Artificial Sequence
  Description of Artificial Sequence:  Enzymatic Nucleic Acid
ggcuccaggccgaaaggcgagugaggucucaggagac

SEQ ID NO: 18175 - RNA, 37 nt, Artificial Sequence
  Description of Artificial Sequence:  Enzymatic Nucleic Acid
ucucgcgggccgaaaggcgagugaggucuuccagcca

SEQ ID NO: 18176 - RNA, 37 nt, Artificial Sequence
  Description of Artificial Sequence:  Enzymatic Nucleic Acid
ccgucucggccgaaaggcgagugaggucuggcuccag

SEQ ID NO: 18177 - RNA, 37 nt, Artificial Sequence
  Description of Artificial Sequence:  Enzymatic Nucleic Acid
ccugagcggccgaaaggcgagugaggucuccgucucg

SEQ ID NO: 18178 - RNA, 37 nt, Artificial Sequence
  Description of Artificial Sequence:  Enzymatic Nucleic Acid
gcccugaggccgaaaggcgagugaggucugcccgucu

SEQ ID NO: 18179 - RNA, 37 nt, Artificial Sequence
  Description of Artificial Sequence:  Enzymatic Nucleic Acid
gccccgcggccgaaaggcgagugaggucuccugagcg

SEQ ID NO: 18180 - RNA, 37 nt, Artificial Sequence
  Description of Artificial Sequence:  Enzymatic Nucleic Acid
cggccccggccgaaaggcgagugaggucugcccugag

SEQ ID NO: 18181 - RNA, 37 nt, Artificial Sequence
  Description of Artificial Sequence:  Enzymatic Nucleic Acid
gccgccgggccgaaaggcgagugaggucucccgcgcc

SEQ ID NO: 18182 - RNA, 37 nt, Artificial Sequence
  Description of Artificial Sequence:  Enzymatic Nucleic Acid
cgccgccggccgaaaggcgagugaggucucggccccg

SEQ ID NO: 18183 - RNA, 37 nt, Artificial Sequence
  Description of Artificial Sequence:  Enzymatic Nucleic Acid
guucgccggccgaaaggcgagugaggucucgccggcc

SEQ ID NO: 18184 - RNA, 37 nt, Artificial Sequence
  Description of Artificial Sequence:  Enzymatic Nucleic Acid
cucguucggccgaaaggcgagugaggucucgccgccg

SEQ ID NO: 18185 - RNA, 37 nt, Artificial Sequence
  Description of Artificial Sequence:  Enzymatic Nucleic Acid
cccggccggccgaaaggcgagugaggucucagagucc

SEQ ID NO: 18186 - RNA, 37 nt, Artificial Sequence
  Description of Artificial Sequence:  Enzymatic Nucleic Acid
cgacccgggccgaaaggcgagugaggucucgccagag

SEQ ID NO: 18187 - RNA, 37 nt, Artificial Sequence
  Description of Artificial Sequence:  Enzymatic Nucleic Acid
gccaacgagccgaaaggcgagugaggucuccggccgc

SEQ ID NO: 18188 - RNA, 37 nt, Artificial Sequence
  Description of Artificial Sequence:  Enzymatic Nucleic Acid
ccggccaagccgaaaggcgagugaggucugacccggc

SEQ ID NO: 18189 - RNA, 37 nt, Artificial Sequence
  Description of Artificial Sequence:  Enzymatic Nucleic Acid
ucccccgggccgaaaggcgagugaggucucaacgacc

SEQ ID NO: 18190 - RNA, 37 nt, Artificial Sequence
  Description of Artificial Sequence:  Enzymatic Nucleic Acid
ugcccgcggccgaaaggcgagugaggucuucccccgg

SEQ ID NO: 18191 - RNA, 37 nt, Artificial Sequence
  Description of Artificial Sequence:  Enzymatic Nucleic Acid
ggugcccggccgaaaggcgagugaggucugcuccccc

SEQ ID NO: 18192 - RNA, 37 nt, Artificial Sequence
  Description of Artificial Sequence:  Enzymatic Nucleic Acid
gcccgguggccgaaaggcgagugaggucuccgcgcuc

SEQ ID NO: 18193 - RNA, 37 nt, Artificial Sequence
  Description of Artificial Sequence:  Enzymatic Nucleic Acid
ccugcucggccgaaaggcgagugaggucuccggugcc

SEQ ID NO: 18194 - RNA, 37 nt, Artificial Sequence
  Description of Artificial Sequence:  Enzymatic Nucleic Acid
gcggccuggccgaaaggcgagugaggucuucgcccgg

SEQ ID NO: 18195 - RNA, 37 nt, Artificial Sequence
  Description of Artificial Sequence:  Enzymatic Nucleic Acid
cgacgcgggccgaaaggcgagugaggucucugcucgc

SEQ ID NO: 18196 - RNA, 37 nt, Artificial Sequence
  Description of Artificial Sequence:  Enzymatic Nucleic Acid
gcgcgacggccgaaaggcgagugaggucuggccugcu

SEQ ID NO: 18197 - RNA, 37 nt, Artificial Sequence
  Description of Artificial Sequence:  Enzymatic Nucleic Acid
gagcgcgagccgaaaggcgagugaggucugcggccug

SEQ ID NO: 18198 - RNA, 37 nt, Artificial Sequence
  Description of Artificial Sequence:  Enzymatic Nucleic Acid
ggugagcggccgaaaggcgagugaggucugacgcggc

SEQ ID NO: 18199 - RNA, 37 nt, Artificial Sequence
  Description of Artificial Sequence:  Enzymatic Nucleic Acid
auggugaggccgaaaggcgagugaggucugcgacgcg

SEQ ID NO: 18200 - RNA, 37 nt, Artificial Sequence
  Description of Artificial Sequence:  Enzymatic Nucleic Acid
guagcugagccgaaaggcgagugaggucucaugguga

SEQ ID NO: 18201 - RNA, 37 nt, Artificial Sequence
  Description of Artificial Sequence:  Enzymatic Nucleic Acid
cccaguaggccgaaaggcgagugaggucuugaccaug

SEQ ID NO: 18202 - RNA, 37 nt, Artificial Sequence
  Description of Artificial Sequence:  Enzymatic Nucleic Acid
cagcaggagccgaaaggcgagugaggucucccggugu

SEQ ID NO: 18203 - RNA, 37 nt, Artificial Sequence
  Description of Artificial Sequence:  Enzymatic Nucleic Acid
gcgcacaggccgaaaggcgagugaggucuaggacccc

SEQ ID NO: 18204 - RNA, 37 nt, Artificial Sequence
  Description of Artificial Sequence:  Enzymatic Nucleic Acid
agcgcgcagccgaaaggcgagugaggucuagcaggac

SEQ ID NO: 18205 - RNA, 37 nt, Artificial Sequence
  Description of Artificial Sequence:  Enzymatic Nucleic Acid
gcagcgcggccgaaaggcgagugaggucuacagcagg

SEQ ID NO: 18206 - RNA, 37 nt, Artificial Sequence
  Description of Artificial Sequence:  Enzymatic Nucleic Acid
gagcagcggccgaaaggcgagugaggucugcacagca

SEQ ID NO: 18207 - RNA, 37 nt, Artificial Sequence
  Description of Artificial Sequence:  Enzymatic Nucleic Acid
cugagcaggccgaaaggcgagugaggucugcgcacag

SEQ ID NO: 18208 - RNA, 37 nt, Artificial Sequence
  Description of Artificial Sequence:  Enzymatic Nucleic Acid
cagcugaggccgaaaggcgagugaggucuagcgcgca

SEQ ID NO: 18209 - RNA, 37 nt, Artificial Sequence
  Description of Artificial Sequence:  Enzymatic Nucleic Acid
gcagacaggccgaaaggcgagugaggucuugagcagc

SEQ ID NO: 18210 - RNA, 37 nt, Artificial Sequence
  Description of Artificial Sequence:  Enzymatic Nucleic Acid
gaagcagagccgaaaggcgagugaggucuagcugagc

SEQ ID NO: 18211 - RNA, 37 nt, Artificial Sequence
  Description of Artificial Sequence:  Enzymatic Nucleic Acid
gugagaaggccgaaaggcgagugaggucuagacagcu

SEQ ID NO: 18212 - RNA, 37 nt, Artificial Sequence
  Description of Artificial Sequence:  Enzymatic Nucleic Acid
aaccugaagccgaaaggcgagugaggucuuagauccu

SEQ ID NO: 18213 - RNA, 37 nt, Artificial Sequence
  Description of Artificial Sequence:  Enzymatic Nucleic Acid
auuuugaagccgaaaggcgagugaggucucugaacua

SEQ ID NO: 18214 - RNA, 37 nt, Artificial Sequence
  Description of Artificial Sequence:  Enzymatic Nucleic Acid
cuuuuaaagccgaaaggcgagugaggucuucaguuca

SEQ ID NO: 18215 - RNA, 37 nt, Artificial Sequence
  Description of Artificial Sequence:  Enzymatic Nucleic Acid
gcuggguggccgaaaggcgagugaggucucuuuuaaa

SEQ ID NO: 18216 - RNA, 37 nt, Artificial Sequence
  Description of Artificial Sequence:  Enzymatic Nucleic Acid
augauguggccgaaaggcgagugaggucuugggugcc

SEQ ID NO: 18217 - RNA, 37 nt, Artificial Sequence
  Description of Artificial Sequence:  Enzymatic Nucleic Acid
ccugcuuggccgaaaggcgagugaggucuaugaugug

SEQ ID NO: 18218 - RNA, 37 nt, Artificial Sequence
  Description of Artificial Sequence:  Enzymatic Nucleic Acid
cuggccuggccgaaaggcgagugaggucuuugcauga

SEQ ID NO: 18219 - RNA, 37 nt, Artificial Sequence
  Description of Artificial Sequence:  Enzymatic Nucleic Acid
gugucugggccgaaaggcgagugaggucucugcuugc

SEQ ID NO: 18220 - RNA, 37 nt, Artificial Sequence
  Description of Artificial Sequence:  Enzymatic Nucleic Acid
uggagauggccgaaaggcgagugaggucuagugucug

SEQ ID NO: 18221 - RNA, 37 nt, Artificial Sequence
  Description of Artificial Sequence:  Enzymatic Nucleic Acid
ccccccuggccgaaaggcgagugaggucuauuggaga

SEQ ID NO: 18222 - RNA, 37 nt, Artificial Sequence
  Description of Artificial Sequence:  Enzymatic Nucleic Acid
augggcuggccgaaaggcgagugaggucuuucccccc

SEQ ID NO: 18223 - RNA, 37 nt, Artificial Sequence
  Description of Artificial Sequence:  Enzymatic Nucleic Acid
uuuauggggccgaaaggcgagugaggucuugcuuccc

SEQ ID NO: 18224 - RNA, 37 nt, Artificial Sequence
  Description of Artificial Sequence:  Enzymatic Nucleic Acid
ggcaaagagccgaaaggcgagugaggucucauuuaug

SEQ ID NO: 18225 - RNA, 37 nt, Artificial Sequence
  Description of Artificial Sequence:  Enzymatic Nucleic Acid
auuucagggccgaaaggcgagugaggucuaaagacca

SEQ ID NO: 18226 - RNA, 37 nt, Artificial Sequence
  Description of Artificial Sequence:  Enzymatic Nucleic Acid
cuuacucagccgaaaggcgagugaggucucauuucag

SEQ ID NO: 18227 - RNA, 37 nt, Artificial Sequence
  Description of Artificial Sequence:  Enzymatic Nucleic Acid
uuuccuuagccgaaaggcgagugaggucuucaccauu

SEQ ID NO: 18228 - RNA, 37 nt, Artificial Sequence
  Description of Artificial Sequence:  Enzymatic Nucleic Acid
gccuuucggccgaaaggcgagugaggucuuuuccuua

SEQ ID NO: 18229 - RNA, 37 nt, Artificial Sequence
  Description of Artificial Sequence:  Enzymatic Nucleic Acid
augcucaggccgaaaggcgagugaggucucuuucgcu

SEQ ID NO: 18230 - RNA, 37 nt, Artificial Sequence
  Description of Artificial Sequence:  Enzymatic Nucleic Acid
uaguuauggccgaaaggcgagugaggucuucagccuu

SEQ ID NO: 18231 - RNA, 37 nt, Artificial Sequence
  Description of Artificial Sequence:  Enzymatic Nucleic Acid
uccacagggccgaaaggcgagugaggucuagauuuag

SEQ ID NO: 18232 - RNA, 37 nt, Artificial Sequence
  Description of Artificial Sequence:  Enzymatic Nucleic Acid
uucuuccagccgaaaggcgagugaggucuaggcagau

SEQ ID NO: 18233 - RNA, 37 nt, Artificial Sequence
  Description of Artificial Sequence:  Enzymatic Nucleic Acid
auuguuuggccgaaaggcgagugaggucucauuucuu

SEQ ID NO: 18234 - RNA, 37 nt, Artificial Sequence
  Description of Artificial Sequence:  Enzymatic Nucleic Acid
aaguacuggccgaaaggcgagugaggucuagaauugu

SEQ ID NO: 18235 - RNA, 37 nt, Artificial Sequence
  Description of Artificial Sequence:  Enzymatic Nucleic Acid
uuaaaguagccgaaaggcgagugaggucuugcagaau

SEQ ID NO: 18236 - RNA, 37 nt, Artificial Sequence
  Description of Artificial Sequence:  Enzymatic Nucleic Acid
ugcuugaggccgaaaggcgagugaggucuuguguuca

SEQ ID NO: 18237 - RNA, 37 nt, Artificial Sequence
  Description of Artificial Sequence:  Enzymatic Nucleic Acid
gugguuuggccgaaaggcgagugaggucuuugagcug

SEQ ID NO: 18238 - RNA, 37 nt, Artificial Sequence
  Description of Artificial Sequence:  Enzymatic Nucleic Acid
uguagaaggccgaaaggcgagugaggucucagugugg

SEQ ID NO: 18239 - RNA, 37 nt, Artificial Sequence
  Description of Artificial Sequence:  Enzymatic Nucleic Acid
auuugcaggccgaaaggcgagugaggucuuguagaag

SEQ ID NO: 18240 - RNA, 37 nt, Artificial Sequence
  Description of Artificial Sequence:  Enzymatic Nucleic Acid
gauauuuggccgaaaggcgagugaggucuagcuguag

SEQ ID NO: 18241 - RNA, 37 nt, Artificial Sequence
  Description of Artificial Sequence:  Enzymatic Nucleic Acid
agguacaggccgaaaggcgagugaggucuuagauauu

SEQ ID NO: 18242 - RNA, 37 nt, Artificial Sequence
  Description of Artificial Sequence:  Enzymatic Nucleic Acid
aguagguagccgaaaggcgagugaggucuagcuagau

SEQ ID NO: 18243 - RNA, 37 nt, Artificial Sequence
  Description of Artificial Sequence:  Enzymatic Nucleic Acid
auagauuggccgaaaggcgagugaggucuagauucug

SEQ ID NO: 18244 - RNA, 37 nt, Artificial Sequence
  Description of Artificial Sequence:  Enzymatic Nucleic Acid
cuguaucagccgaaaggcgagugaggucuuaauaaau

SEQ ID NO: 18245 - RNA, 37 nt, Artificial Sequence
  Description of Artificial Sequence:  Enzymatic Nucleic Acid
aaggucuagccgaaaggcgagugaggucucuguauca

SEQ ID NO: 18246 - RNA, 37 nt, Artificial Sequence
  Description of Artificial Sequence:  Enzymatic Nucleic Acid
caucucuagccgaaaggcgagugaggucugaaagguc

SEQ ID NO: 18247 - RNA, 37 nt, Artificial Sequence
  Description of Artificial Sequence:  Enzymatic Nucleic Acid
ucacuguagccgaaaggcgagugaggucuaucucuac

SEQ ID NO: 18248 - RNA, 37 nt, Artificial Sequence
  Description of Artificial Sequence:  Enzymatic Nucleic Acid
ggauuucagccgaaaggcgagugaggucuuguacauc

SEQ ID NO: 18249 - RNA, 37 nt, Artificial Sequence
  Description of Artificial Sequence:  Enzymatic Nucleic Acid
augacgaggccgaaaggcgagugaggucuucccuucc

SEQ ID NO: 18250 - RNA, 37 nt, Artificial Sequence
  Description of Artificial Sequence:  Enzymatic Nucleic Acid
gggaaugagccgaaaggcgagugaggucugagcuccc

SEQ ID NO: 18251 - RNA, 37 nt, Artificial Sequence
  Description of Artificial Sequence:  Enzymatic Nucleic Acid
uaacccgggccgaaaggcgagugaggucuagggaaug

SEQ ID NO: 18252 - RNA, 37 nt, Artificial Sequence
  Description of Artificial Sequence:  Enzymatic Nucleic Acid
ugacguaagccgaaaggcgagugaggucuccggcagg

SEQ ID NO: 18253 - RNA, 37 nt, Artificial Sequence
  Description of Artificial Sequence:  Enzymatic Nucleic Acid
uuaggugagccgaaaggcgagugaggucuguaacccg

SEQ ID NO: 18254 - RNA, 37 nt, Artificial Sequence
  Description of Artificial Sequence:  Enzymatic Nucleic Acid
uaaaguaagccgaaaggcgagugaggucuagugaugu

SEQ ID NO: 18255 - RNA, 37 nt, Artificial Sequence
  Description of Artificial Sequence:  Enzymatic Nucleic Acid
aguggaaagccgaaaggcgagugaggucuuuuuuuaa

SEQ ID NO: 18256 - RNA, 37 nt, Artificial Sequence
  Description of Artificial Sequence:  Enzymatic Nucleic Acid
agauuauggccgaaaggcgagugaggucuguuuucca

SEQ ID NO: 18257 - RNA, 37 nt, Artificial Sequence
  Description of Artificial Sequence:  Enzymatic Nucleic Acid
ccuuucuagccgaaaggcgagugaggucuugucccag

SEQ ID NO: 18258 - RNA, 37 nt, Artificial Sequence
  Description of Artificial Sequence:  Enzymatic Nucleic Acid
ugaugaaggccgaaaggcgagugaggucuccuuucua

SEQ ID NO: 18259 - RNA, 37 nt, Artificial Sequence
  Description of Artificial Sequence:  Enzymatic Nucleic Acid
guacguuggccgaaaggcgagugaggucuauuugaua

SEQ ID NO: 18260 - RNA, 37 nt, Artificial Sequence
  Description of Artificial Sequence:  Enzymatic Nucleic Acid
ucuuuguagccgaaaggcgagugaggucuguugcauu

SEQ ID NO: 18261 - RNA, 37 nt, Artificial Sequence
  Description of Artificial Sequence:  Enzymatic Nucleic Acid
gucagaaggccgaaaggcgagugaggucuccuauuuc

SEQ ID NO: 18262 - RNA, 37 nt, Artificial Sequence
  Description of Artificial Sequence:  Enzymatic Nucleic Acid
uugcuucagccgaaaggcgagugaggucuaggucaga

SEQ ID NO: 18263 - RNA, 37 nt, Artificial Sequence
  Description of Artificial Sequence:  Enzymatic Nucleic Acid
gacuguuggccgaaaggcgagugaggucuuucacagg

SEQ ID NO: 18264 - RNA, 37 nt, Artificial Sequence
  Description of Artificial Sequence:  Enzymatic Nucleic Acid
cccauugagccgaaaggcgagugaggucuuguugcuu

SEQ ID NO: 18265 - RNA, 37 nt, Artificial Sequence
  Description of Artificial Sequence:  Enzymatic Nucleic Acid
uacaaauggccgaaaggcgagugaggucuccauugac

SEQ ID NO: 18266 - RNA, 37 nt, Artificial Sequence
  Description of Artificial Sequence:  Enzymatic Nucleic Acid
gucuuauagccgaaaggcgagugaggucuaaaugccc

SEQ ID NO: 18267 - RNA, 37 nt, Artificial Sequence
  Description of Artificial Sequence:  Enzymatic Nucleic Acid
uauuuggagccgaaaggcgagugaggucuaucuauga

SEQ ID NO: 18268 - RNA, 37 nt, Artificial Sequence
  Description of Artificial Sequence:  Enzymatic Nucleic Acid
gugguguggccgaaaggcgagugaggucuuuauuugg

SEQ ID NO: 18269 - RNA, 37 nt, Artificial Sequence
  Description of Artificial Sequence:  Enzymatic Nucleic Acid
ugacuggggccgaaaggcgagugaggucuguggugug

SEQ ID NO: 18270 - RNA, 37 nt, Artificial Sequence
  Description of Artificial Sequence:  Enzymatic Nucleic Acid
uaauuugagccgaaaggcgagugaggucuugggcgug

SEQ ID NO: 18271 - RNA, 37 nt, Artificial Sequence
  Description of Artificial Sequence:  Enzymatic Nucleic Acid
gaguaugggccgaaaggcgagugaggucucucuaagu

SEQ ID NO: 18272 - RNA, 37 nt, Artificial Sequence
  Description of Artificial Sequence:  Enzymatic Nucleic Acid
auugaggagccgaaaggcgagugaggucuaagaguau

SEQ ID NO: 18273 - RNA, 37 nt, Artificial Sequence
  Description of Artificial Sequence:  Enzymatic Nucleic Acid
uagcaguagccgaaaggcgagugaggucuaauugagg

SEQ ID NO: 18274 - RNA, 37 nt, Artificial Sequence
  Description of Artificial Sequence:  Enzymatic Nucleic Acid
agugguaggccgaaaggcgagugaggucuaguacaau

SEQ ID NO: 18275 - RNA, 37 nt, Artificial Sequence
  Description of Artificial Sequence:  Enzymatic Nucleic Acid
cauuugaagccgaaaggcgagugaggucuucucgugu

SEQ ID NO: 18276 - RNA, 37 nt, Artificial Sequence
  Description of Artificial Sequence:  Enzymatic Nucleic Acid
caggguaagccgaaaggcgagugaggucuuccagguc

SEQ ID NO: 18277 - RNA, 37 nt, Artificial Sequence
  Description of Artificial Sequence:  Enzymatic Nucleic Acid
uacggaaggccgaaaggcgagugaggucuucucuuau

SEQ ID NO: 18278 - RNA, 37 nt, Artificial Sequence
  Description of Artificial Sequence:  Enzymatic Nucleic Acid
ucgccuuagccgaaaggcgagugaggucuggaagcuc

SEQ ID NO: 18279 - RNA, 37 nt, Artificial Sequence
  Description of Artificial Sequence:  Enzymatic Nucleic Acid
auucgucggccgaaaggcgagugaggucucuuacgga

SEQ ID NO: 18280 - RNA, 37 nt, Artificial Sequence
  Description of Artificial Sequence:  Enzymatic Nucleic Acid
gggaauuggccgaaaggcgagugaggucuuuugguca

SEQ ID NO: 18281 - RNA, 37 nt, Artificial Sequence
  Description of Artificial Sequence:  Enzymatic Nucleic Acid
uauguugggccgaaaggcgagugaggucuaugggaau

SEQ ID NO: 18282 - RNA, 37 nt, Artificial Sequence
  Description of Artificial Sequence:  Enzymatic Nucleic Acid
uaagaacagccgaaaggcgagugaggucuuguagaau

SEQ ID NO: 18283 - RNA, 37 nt, Artificial Sequence
  Description of Artificial Sequence:  Enzymatic Nucleic Acid
aguaagaagccgaaaggcgagugaggucuacuguaga

SEQ ID NO: 18284 - RNA, 37 nt, Artificial Sequence
  Description of Artificial Sequence:  Enzymatic Nucleic Acid
uuguucuggccgaaaggcgagugaggucuauuuuguc

SEQ ID NO: 18285 - RNA, 37 nt, Artificial Sequence
  Description of Artificial Sequence:  Enzymatic Nucleic Acid
uuacacgagccgaaaggcgagugaggucuaaguauaa

SEQ ID NO: 18286 - RNA, 37 nt, Artificial Sequence
  Description of Artificial Sequence:  Enzymatic Nucleic Acid
uccuuacagccgaaaggcgagugaggucugacaagua

SEQ ID NO: 18287 - RNA, 37 nt, Artificial Sequence
  Description of Artificial Sequence:  Enzymatic Nucleic Acid
acuccuuagccgaaaggcgagugaggucuacgacaag

SEQ ID NO: 18288 - RNA, 37 nt, Artificial Sequence
  Description of Artificial Sequence:  Enzymatic Nucleic Acid
augguccagccgaaaggcgagugaggucuuccuuaca

SEQ ID NO: 18289 - RNA, 37 nt, Artificial Sequence
  Description of Artificial Sequence:  Enzymatic Nucleic Acid
gguguuaagccgaaaggcgagugaggucuagauuuga

SEQ ID NO: 18290 - RNA, 37 nt, Artificial Sequence
  Description of Artificial Sequence:  Enzymatic Nucleic Acid
uauaugcagccgaaaggcgagugaggucuugaggugu

SEQ ID NO: 18291 - RNA, 37 nt, Artificial Sequence
  Description of Artificial Sequence:  Enzymatic Nucleic Acid
uauauauggccgaaaggcgagugaggucuacugaggu

SEQ ID NO: 18292 - RNA, 37 nt, Artificial Sequence
  Description of Artificial Sequence:  Enzymatic Nucleic Acid
gaugaauggccgaaaggcgagugaggucuuuuaucau

SEQ ID NO: 18293 - RNA, 37 nt, Artificial Sequence
  Description of Artificial Sequence:  Enzymatic Nucleic Acid
auguuucagccgaaaggcgagugaggucuagugauga

SEQ ID NO: 18294 - RNA, 37 nt, Artificial Sequence
  Description of Artificial Sequence:  Enzymatic Nucleic Acid
agcaccuggccgaaaggcgagugaggucuuguuuucg

SEQ ID NO: 18295 - RNA, 37 nt, Artificial Sequence
  Description of Artificial Sequence:  Enzymatic Nucleic Acid
uucaagcagccgaaaggcgagugaggucucugcuguu

SEQ ID NO: 18296 - RNA, 37 nt, Artificial Sequence
  Description of Artificial Sequence:  Enzymatic Nucleic Acid
guuucaaggccgaaaggcgagugaggucuaccugcug

SEQ ID NO: 18297 - RNA, 37 nt, Artificial Sequence
  Description of Artificial Sequence:  Enzymatic Nucleic Acid
gccagcuagccgaaaggcgagugaggucugguuucaa

SEQ ID NO: 18298 - RNA, 37 nt, Artificial Sequence
  Description of Artificial Sequence:  Enzymatic Nucleic Acid
cuugccaggccgaaaggcgagugaggucuuacgguuu

SEQ ID NO: 18299 - RNA, 37 nt, Artificial Sequence
  Description of Artificial Sequence:  Enzymatic Nucleic Acid
accgcuuggccgaaaggcgagugaggucucagcuacg

SEQ ID NO: 18300 - RNA, 37 nt, Artificial Sequence
  Description of Artificial Sequence:  Enzymatic Nucleic Acid
uaagaccggccgaaaggcgagugaggucuuugccagc

SEQ ID NO: 18301 - RNA, 37 nt, Artificial Sequence
  Description of Artificial Sequence:  Enzymatic Nucleic Acid
cgguaagagccgaaaggcgagugaggucucgcuugcc

SEQ ID NO: 18302 - RNA, 37 nt, Artificial Sequence
  Description of Artificial Sequence:  Enzymatic Nucleic Acid
auagagaggccgaaaggcgagugaggucucgguaaga

SEQ ID NO: 18303 - RNA, 37 nt, Artificial Sequence
  Description of Artificial Sequence:  Enzymatic Nucleic Acid
ugccuucagccgaaaggcgagugaggucuuuucauag

SEQ ID NO: 18304 - RNA, 37 nt, Artificial Sequence
  Description of Artificial Sequence:  Enzymatic Nucleic Acid
gggaaauggccgaaaggcgagugaggucucuucacuu

SEQ ID NO: 18305 - RNA, 37 nt, Artificial Sequence
  Description of Artificial Sequence:  Enzymatic Nucleic Acid
acuuccgggccgaaaggcgagugaggucugagggaaa

SEQ ID NO: 18306 - RNA, 37 nt, Artificial Sequence
  Description of Artificial Sequence:  Enzymatic Nucleic Acid
ccauacaagccgaaaggcgagugaggucuuuccggcg

SEQ ID NO: 18307 - RNA, 37 nt, Artificial Sequence
  Description of Artificial Sequence:  Enzymatic Nucleic Acid
uaaccauagccgaaaggcgagugaggucuaacuuccg

SEQ ID NO: 18308 - RNA, 37 nt, Artificial Sequence
  Description of Artificial Sequence:  Enzymatic Nucleic Acid
ucuuuuaagccgaaaggcgagugaggucucauacaac

SEQ ID NO: 18309 - RNA, 37 nt, Artificial Sequence
  Description of Artificial Sequence:  Enzymatic Nucleic Acid
gcagguaagccgaaaggcgagugaggucuccaucuuu

SEQ ID NO: 18310 - RNA, 37 nt, Artificial Sequence
  Description of Artificial Sequence:  Enzymatic Nucleic Acid
cucagucggccgaaaggcgagugaggucuagguaacc

SEQ ID NO: 18311 - RNA, 37 nt, Artificial Sequence
  Description of Artificial Sequence:  Enzymatic Nucleic Acid
auagcgaggccgaaaggcgagugaggucuagauuucu

SEQ ID NO: 18312 - RNA, 37 nt, Artificial Sequence
  Description of Artificial Sequence:  Enzymatic Nucleic Acid
ucaaauaggccgaaaggcgagugaggucugagcagau

SEQ ID NO: 18313 - RNA, 37 nt, Artificial Sequence
  Description of Artificial Sequence:  Enzymatic Nucleic Acid
aguagccagccgaaaggcgagugaggucugagucaaa

SEQ ID NO: 18314 - RNA, 37 nt, Artificial Sequence
  Description of Artificial Sequence:  Enzymatic Nucleic Acid
acgaguaggccgaaaggcgagugaggucucacgaguc

SEQ ID NO: 18315 - RNA, 37 nt, Artificial Sequence
  Description of Artificial Sequence:  Enzymatic Nucleic Acid
auaauuaagccgaaaggcgagugaggucugaguagcc

SEQ ID NO: 18316 - RNA, 37 nt, Artificial Sequence
  Description of Artificial Sequence:  Enzymatic Nucleic Acid
uucaguuagccgaaaggcgagugaggucuguccuuga

SEQ ID NO: 18317 - RNA, 37 nt, Artificial Sequence
  Description of Artificial Sequence:  Enzymatic Nucleic Acid
auucccuggccgaaaggcgagugaggucuauccucuu

SEQ ID NO: 18318 - RNA, 37 nt, Artificial Sequence
  Description of Artificial Sequence:  Enzymatic Nucleic Acid
augcucaggccgaaaggcgagugaggucuaagauugu

SEQ ID NO: 18319 - RNA, 37 nt, Artificial Sequence
  Description of Artificial Sequence:  Enzymatic Nucleic Acid
guuuuauggccgaaaggcgagugaggucuucagcaag

SEQ ID NO: 18320 - RNA, 37 nt, Artificial Sequence
  Description of Artificial Sequence:  Enzymatic Nucleic Acid
acauuugagccgaaaggcgagugaggucuuguuuuau

SEQ ID NO: 18321 - RNA, 37 nt, Artificial Sequence
  Description of Artificial Sequence:  Enzymatic Nucleic Acid
uuuaaacagccgaaaggcgagugaggucuauuugacu

SEQ ID NO: 18322 - RNA, 37 nt, Artificial Sequence
  Description of Artificial Sequence:  Enzymatic Nucleic Acid
uuuuuaaagccgaaaggcgagugaggucuacauuuga

SEQ ID NO: 18323 - RNA, 37 nt, Artificial Sequence
  Description of Artificial Sequence:  Enzymatic Nucleic Acid
uagagugggccgaaaggcgagugaggucuagugaggu

SEQ ID NO: 18324 - RNA, 37 nt, Artificial Sequence
  Description of Artificial Sequence:  Enzymatic Nucleic Acid
cacauugagccgaaaggcgagugaggucuaauuagag

SEQ ID NO: 18325 - RNA, 37 nt, Artificial Sequence
  Description of Artificial Sequence:  Enzymatic Nucleic Acid
ggguuucagccgaaaggcgagugaggucuauugacaa

SEQ ID NO: 18326 - RNA, 37 nt, Artificial Sequence
  Description of Artificial Sequence:  Enzymatic Nucleic Acid
ugacacgggccgaaaggcgagugaggucucuuuucgu

SEQ ID NO: 18327 - RNA, 37 nt, Artificial Sequence
  Description of Artificial Sequence:  Enzymatic Nucleic Acid
cgaugacagccgaaaggcgagugaggucuggccuuuu

SEQ ID NO: 18328 - RNA, 37 nt, Artificial Sequence
  Description of Artificial Sequence:  Enzymatic Nucleic Acid
aacgaugagccgaaaggcgagugaggucuacggccuu

SEQ ID NO: 18329 - RNA, 37 nt, Artificial Sequence
  Description of Artificial Sequence:  Enzymatic Nucleic Acid
ucuggaaagccgaaaggcgagugaggucugaugacac

SEQ ID NO: 18330 - RNA, 37 nt, Artificial Sequence
  Description of Artificial Sequence:  Enzymatic Nucleic Acid
guagagaggccgaaaggcgagugaggucucgggucug

SEQ ID NO: 18331 - RNA, 37 nt, Artificial Sequence
  Description of Artificial Sequence:  Enzymatic Nucleic Acid
gucugcuggccgaaaggcgagugaggucuccaguggg

SEQ ID NO: 18332 - RNA, 37 nt, Artificial Sequence
  Description of Artificial Sequence:  Enzymatic Nucleic Acid
uuugucuggccgaaaggcgagugaggucuugcccagu

SEQ ID NO: 18333 - RNA, 37 nt, Artificial Sequence
  Description of Artificial Sequence:  Enzymatic Nucleic Acid
augcgguagccgaaaggcgagugaggucuaagucagg

SEQ ID NO: 18334 - RNA, 37 nt, Artificial Sequence
  Description of Artificial Sequence:  Enzymatic Nucleic Acid
accauauggccgaaaggcgagugaggucugguacaag

SEQ ID NO: 18335 - RNA, 37 nt, Artificial Sequence
  Description of Artificial Sequence:  Enzymatic Nucleic Acid
gagggauagccgaaaggcgagugaggucucauaugcg

SEQ ID NO: 18336 - RNA, 37 nt, Artificial Sequence
  Description of Artificial Sequence:  Enzymatic Nucleic Acid
cagaaccagccgaaaggcgagugaggucuuugauugu

SEQ ID NO: 18337 - RNA, 37 nt, Artificial Sequence
  Description of Artificial Sequence:  Enzymatic Nucleic Acid
ugccagaagccgaaaggcgagugaggucucacuugau

SEQ ID NO: 18338 - RNA, 37 nt, Artificial Sequence
  Description of Artificial Sequence:  Enzymatic Nucleic Acid
cagggguggccgaaaggcgagugaggucucagaacca

SEQ ID NO: 18339 - RNA, 37 nt, Artificial Sequence
  Description of Artificial Sequence:  Enzymatic Nucleic Acid
uaugguuagccgaaaggcgagugaggucuaggggugc

SEQ ID NO: 18340 - RNA, 37 nt, Artificial Sequence
  Description of Artificial Sequence:  Enzymatic Nucleic Acid
acaccuuggccgaaaggcgagugaggucuuucggaau

SEQ ID NO: 18341 - RNA, 37 nt, Artificial Sequence
  Description of Artificial Sequence:  Enzymatic Nucleic Acid
aagucacagccgaaaggcgagugaggucucuugcuuc

SEQ ID NO: 18342 - RNA, 37 nt, Artificial Sequence
  Description of Artificial Sequence:  Enzymatic Nucleic Acid
aaaagucagccgaaaggcgagugaggucuaccuugcu

SEQ ID NO: 18343 - RNA, 37 nt, Artificial Sequence
  Description of Artificial Sequence:  Enzymatic Nucleic Acid
uauuggaagccgaaaggcgagugaggucuaaaaguca

SEQ ID NO: 18344 - RNA, 37 nt, Artificial Sequence
  Description of Artificial Sequence:  Enzymatic Nucleic Acid
auaaaggagccgaaaggcgagugaggucuucuucauu

SEQ ID NO: 18345 - RNA, 37 nt, Artificial Sequence
  Description of Artificial Sequence:  Enzymatic Nucleic Acid
gcugucaggccgaaaggcgagugaggucuauccagga

SEQ ID NO: 18346 - RNA, 37 nt, Artificial Sequence
  Description of Artificial Sequence:  Enzymatic Nucleic Acid
ccauguuggccgaaaggcgagugaggucuugucagca

SEQ ID NO: 18347 - RNA, 37 nt, Artificial Sequence
  Description of Artificial Sequence:  Enzymatic Nucleic Acid
gagugauggccgaaaggcgagugaggucuucucaauu

SEQ ID NO: 18348 - RNA, 37 nt, Artificial Sequence
  Description of Artificial Sequence:  Enzymatic Nucleic Acid
gccaugcggccgaaaggcgagugaggucuugagugau

SEQ ID NO: 18349 - RNA, 37 nt, Artificial Sequence
  Description of Artificial Sequence:  Enzymatic Nucleic Acid
uugccauggccgaaaggcgagugaggucugcugagug

SEQ ID NO: 18350 - RNA, 37 nt, Artificial Sequence
  Description of Artificial Sequence:  Enzymatic Nucleic Acid
uauuauuggccgaaaggcgagugaggucucaugcgcu

SEQ ID NO: 18351 - RNA, 37 nt, Artificial Sequence
  Description of Artificial Sequence:  Enzymatic Nucleic Acid
ggugcuaggccgaaaggcgagugaggucucaucuuau

SEQ ID NO: 18352 - RNA, 37 nt, Artificial Sequence
  Description of Artificial Sequence:  Enzymatic Nucleic Acid
ccaagguggccgaaaggcgagugaggucuuagccauc

SEQ ID NO: 18353 - RNA, 37 nt, Artificial Sequence
  Description of Artificial Sequence:  Enzymatic Nucleic Acid
agccacaagccgaaaggcgagugaggucucaaggugc

SEQ ID NO: 18354 - RNA, 37 nt, Artificial Sequence
  Description of Artificial Sequence:  Enzymatic Nucleic Acid
gucagccagccgaaaggcgagugaggucuaaccaagg

SEQ ID NO: 18355 - RNA, 37 nt, Artificial Sequence
  Description of Artificial Sequence:  Enzymatic Nucleic Acid
agagucaggccgaaaggcgagugaggucucacaacca

SEQ ID NO: 18356 - RNA, 37 nt, Artificial Sequence
  Description of Artificial Sequence:  Enzymatic Nucleic Acid
aagcuauggccgaaaggcgagugaggucuaaauguag

SEQ ID NO: 18357 - RNA, 37 nt, Artificial Sequence
  Description of Artificial Sequence:  Enzymatic Nucleic Acid
auuggaaggccgaaaggcgagugaggucuuaugcaaa

SEQ ID NO: 18358 - RNA, 37 nt, Artificial Sequence
  Description of Artificial Sequence:  Enzymatic Nucleic Acid
agucccaagccgaaaggcgagugaggucuuuuauugg

SEQ ID NO: 18359 - RNA, 37 nt, Artificial Sequence
  Description of Artificial Sequence:  Enzymatic Nucleic Acid
ucuucccagccgaaaggcgagugaggucuagucccaa

SEQ ID NO: 18360 - RNA, 37 nt, Artificial Sequence
  Description of Artificial Sequence:  Enzymatic Nucleic Acid
uauaaaaggccgaaaggcgagugaggucuuuauguuu

SEQ ID NO: 18361 - RNA, 37 nt, Artificial Sequence
  Description of Artificial Sequence:  Enzymatic Nucleic Acid
auuuggcagccgaaaggcgagugaggucuaucuguga

SEQ ID NO: 18362 - RNA, 37 nt, Artificial Sequence
  Description of Artificial Sequence:  Enzymatic Nucleic Acid
ccauuugggccgaaaggcgagugaggucuacaucugu

SEQ ID NO: 18363 - RNA, 37 nt, Artificial Sequence
  Description of Artificial Sequence:  Enzymatic Nucleic Acid
acaugaaagccgaaaggcgagugaggucuccauuugg

SEQ ID NO: 18364 - RNA, 37 nt, Artificial Sequence
  Description of Artificial Sequence:  Enzymatic Nucleic Acid
caaguuaagccgaaaggcgagugaggucuaugaaacc

SEQ ID NO: 18365 - RNA, 37 nt, Artificial Sequence
  Description of Artificial Sequence:  Enzymatic Nucleic Acid
uccgucgggccgaaaggcgagugaggucuauuuuuuc

SEQ ID NO: 18366 - RNA, 37 nt, Artificial Sequence
  Description of Artificial Sequence:  Enzymatic Nucleic Acid
gugcaagagccgaaaggcgagugaggucuaguuucag

SEQ ID NO: 18367 - RNA, 37 nt, Artificial Sequence
  Description of Artificial Sequence:  Enzymatic Nucleic Acid
uaacuguggccgaaaggcgagugaggucuaagacagu

SEQ ID NO: 18368 - RNA, 37 nt, Artificial Sequence
  Description of Artificial Sequence:  Enzymatic Nucleic Acid
cuuguuaagccgaaaggcgagugaggucuugugcaag

SEQ ID NO: 18369 - RNA, 37 nt, Artificial Sequence
  Description of Artificial Sequence:  Enzymatic Nucleic Acid
uauaagaagccgaaaggcgagugaggucuuuguuaac

SEQ ID NO: 18370 - RNA, 37 nt, Artificial Sequence
  Description of Artificial Sequence:  Enzymatic Nucleic Acid
ccaaguaagccgaaaggcgagugaggucugucucugu

SEQ ID NO: 18371 - RNA, 37 nt, Artificial Sequence
  Description of Artificial Sequence:  Enzymatic Nucleic Acid
acuguccggccgaaaggcgagugaggucuaguaaaau

SEQ ID NO: 18372 - RNA, 37 nt, Artificial Sequence
  Description of Artificial Sequence:  Enzymatic Nucleic Acid
guuauuaagccgaaaggcgagugaggucuuguccgca

SEQ ID NO: 18373 - RNA, 37 nt, Artificial Sequence
  Description of Artificial Sequence:  Enzymatic Nucleic Acid
cuguaguggccgaaaggcgagugaggucuauuguucu

SEQ ID NO: 18374 - RNA, 37 nt, Artificial Sequence
  Description of Artificial Sequence:  Enzymatic Nucleic Acid
ugcuaauagccgaaaggcgagugaggucuuguagugc

SEQ ID NO: 18375 - RNA, 37 nt, Artificial Sequence
  Description of Artificial Sequence:  Enzymatic Nucleic Acid
uuugcuuggccgaaaggcgagugaggucuuaauacug

SEQ ID NO: 18376 - RNA, 37 nt, Artificial Sequence
  Description of Artificial Sequence:  Enzymatic Nucleic Acid
auuuuuuggccgaaaggcgagugaggucuuugcuaau

SEQ ID NO: 18377 - RNA, 37 nt, Artificial Sequence
  Description of Artificial Sequence:  Enzymatic Nucleic Acid
agugaugggccgaaaggcgagugaggucucauuuuuu

SEQ ID NO: 18378 - RNA, 37 nt, Artificial Sequence
  Description of Artificial Sequence:  Enzymatic Nucleic Acid
auggaguggccgaaaggcgagugaggucuuccuuagu

SEQ ID NO: 18379 - RNA, 37 nt, Artificial Sequence
  Description of Artificial Sequence:  Enzymatic Nucleic Acid
cagggaaagccgaaaggcgagugaggucuauucauga

SEQ ID NO: 18380 - RNA, 37 nt, Artificial Sequence
  Description of Artificial Sequence:  Enzymatic Nucleic Acid
gaaucuuggccgaaaggcgagugaggucuagggaaac

SEQ ID NO: 18381 - RNA, 37 nt, Artificial Sequence
  Description of Artificial Sequence:  Enzymatic Nucleic Acid
cauagguggccgaaaggcgagugaggucucugaaucu

SEQ ID NO: 18382 - RNA, 37 nt, Artificial Sequence
  Description of Artificial Sequence:  Enzymatic Nucleic Acid
ucugcagggccgaaaggcgagugaggucuauaggugc

SEQ ID NO: 18383 - RNA, 37 nt, Artificial Sequence
  Description of Artificial Sequence:  Enzymatic Nucleic Acid
uggcucuggccgaaaggcgagugaggucuaggcauag

SEQ ID NO: 18384 - RNA, 37 nt, Artificial Sequence
  Description of Artificial Sequence:  Enzymatic Nucleic Acid
auuccugggccgaaaggcgagugaggucuucugcagg

SEQ ID NO: 18385 - RNA, 37 nt, Artificial Sequence
  Description of Artificial Sequence:  Enzymatic Nucleic Acid
uguguauagccgaaaggcgagugaggucuauuccugg

SEQ ID NO: 18386 - RNA, 37 nt, Artificial Sequence
  Description of Artificial Sequence:  Enzymatic Nucleic Acid
guaugguggccgaaaggcgagugaggucuuuccugau

SEQ ID NO: 18387 - RNA, 37 nt, Artificial Sequence
  Description of Artificial Sequence:  Enzymatic Nucleic Acid
agguuucggccgaaaggcgagugaggucuaggaggua

SEQ ID NO: 18388 - RNA, 37 nt, Artificial Sequence
  Description of Artificial Sequence:  Enzymatic Nucleic Acid
ugugaucagccgaaaggcgagugaggucuugagguuu

SEQ ID NO: 18389 - RNA, 37 nt, Artificial Sequence
  Description of Artificial Sequence:  Enzymatic Nucleic Acid
gauggccagccgaaaggcgagugaggucuugugugau

SEQ ID NO: 18390 - RNA, 37 nt, Artificial Sequence
  Description of Artificial Sequence:  Enzymatic Nucleic Acid
gcugaugggccgaaaggcgagugaggucucacugugu

SEQ ID NO: 18391 - RNA, 37 nt, Artificial Sequence
  Description of Artificial Sequence:  Enzymatic Nucleic Acid
uggaacuggccgaaaggcgagugaggucuugauggcc

SEQ ID NO: 18392 - RNA, 37 nt, Artificial Sequence
  Description of Artificial Sequence:  Enzymatic Nucleic Acid
ugguggaagccgaaaggcgagugaggucuugcugaug

SEQ ID NO: 18393 - RNA, 37 nt, Artificial Sequence
  Description of Artificial Sequence:  Enzymatic Nucleic Acid
uagcaugagccgaaaggcgagugaggucuagucuaaa

SEQ ID NO: 18394 - RNA, 37 nt, Artificial Sequence
  Description of Artificial Sequence:  Enzymatic Nucleic Acid
accauuaggccgaaaggcgagugaggucuaugacagu

SEQ ID NO: 18395 - RNA, 37 nt, Artificial Sequence
  Description of Artificial Sequence:  Enzymatic Nucleic Acid
cggggacagccgaaaggcgagugaggucucauuagca

SEQ ID NO: 18396 - RNA, 37 nt, Artificial Sequence
  Description of Artificial Sequence:  Enzymatic Nucleic Acid
cucggggagccgaaaggcgagugaggucuaccauuag

SEQ ID NO: 18397 - RNA, 37 nt, Artificial Sequence
  Description of Artificial Sequence:  Enzymatic Nucleic Acid
aucugagggccgaaaggcgagugaggucuucggggac

SEQ ID NO: 18398 - RNA, 37 nt, Artificial Sequence
  Description of Artificial Sequence:  Enzymatic Nucleic Acid
uuuuuaaagccgaaaggcgagugaggucucaagugau

SEQ ID NO: 18399 - RNA, 37 nt, Artificial Sequence
  Description of Artificial Sequence:  Enzymatic Nucleic Acid
auuccagggccgaaaggcgagugaggucuucuuguug

SEQ ID NO: 18400 - RNA, 37 nt, Artificial Sequence
  Description of Artificial Sequence:  Enzymatic Nucleic Acid
gcgugcuggccgaaaggcgagugaggucuuuccuggu

SEQ ID NO: 18401 - RNA, 37 nt, Artificial Sequence
  Description of Artificial Sequence:  Enzymatic Nucleic Acid
acagcguggccgaaaggcgagugaggucuugcuuccu

SEQ ID NO: 18402 - RNA, 37 nt, Artificial Sequence
  Description of Artificial Sequence:  Enzymatic Nucleic Acid
auaaacaggccgaaaggcgagugaggucugugcugcu

SEQ ID NO: 18403 - RNA, 37 nt, Artificial Sequence
  Description of Artificial Sequence:  Enzymatic Nucleic Acid
ucaauaaagccgaaaggcgagugaggucuagcgugcu

SEQ ID NO: 18404 - RNA, 37 nt, Artificial Sequence
  Description of Artificial Sequence:  Enzymatic Nucleic Acid
uucugugagccgaaaggcgagugaggucuucuuucaa

SEQ ID NO: 18405 - RNA, 37 nt, Artificial Sequence
  Description of Artificial Sequence:  Enzymatic Nucleic Acid
gauagacagccgaaaggcgagugaggucucuucaucc

SEQ ID NO: 18406 - RNA, 37 nt, Artificial Sequence
  Description of Artificial Sequence:  Enzymatic Nucleic Acid
gugauagagccgaaaggcgagugaggucuaccuucau

SEQ ID NO: 18407 - RNA, 37 nt, Artificial Sequence
  Description of Artificial Sequence:  Enzymatic Nucleic Acid
uggcuuuggccgaaaggcgagugaggucuagugauag

SEQ ID NO: 18408 - RNA, 37 nt, Artificial Sequence
  Description of Artificial Sequence:  Enzymatic Nucleic Acid
guuggugggccgaaaggcgagugaggucuuuugcagu

SEQ ID NO: 18409 - RNA, 37 nt, Artificial Sequence
  Description of Artificial Sequence:  Enzymatic Nucleic Acid
ccacagaggccgaaaggcgagugaggucuccuucugg

SEQ ID NO: 18410 - RNA, 37 nt, Artificial Sequence
  Description of Artificial Sequence:  Enzymatic Nucleic Acid
acuuuccagccgaaaggcgagugaggucuagagcccu

SEQ ID NO: 18411 - RNA, 37 nt, Artificial Sequence
  Description of Artificial Sequence:  Enzymatic Nucleic Acid
augcugaagccgaaaggcgagugaggucuuuuccaca

SEQ ID NO: 18412 - RNA, 37 nt, Artificial Sequence
  Description of Artificial Sequence:  Enzymatic Nucleic Acid
gagguauggccgaaaggcgagugaggucuugaacuuu

SEQ ID NO: 18413 - RNA, 37 nt, Artificial Sequence
  Description of Artificial Sequence:  Enzymatic Nucleic Acid
uccuugaagccgaaaggcgagugaggucuagugaggu

SEQ ID NO: 18414 - RNA, 37 nt, Artificial Sequence
  Description of Artificial Sequence:  Enzymatic Nucleic Acid
agauuagagccgaaaggcgagugaggucuuuguccga

SEQ ID NO: 18415 - RNA, 37 nt, Artificial Sequence
  Description of Artificial Sequence:  Enzymatic Nucleic Acid
gugaucaggccgaaaggcgagugaggucuuccagauu

SEQ ID NO: 18416 - RNA, 37 nt, Artificial Sequence
  Description of Artificial Sequence:  Enzymatic Nucleic Acid
cacagguggccgaaaggcgagugaggucuauguuaga

SEQ ID NO: 18417 - RNA, 37 nt, Artificial Sequence
  Description of Artificial Sequence:  Enzymatic Nucleic Acid
cagccacagccgaaaggcgagugaggucuaggugcau

SEQ ID NO: 18418 - RNA, 37 nt, Artificial Sequence
  Description of Artificial Sequence:  Enzymatic Nucleic Acid
cgcagccagccgaaaggcgagugaggucuacaggugc

SEQ ID NO: 18419 - RNA, 37 nt, Artificial Sequence
  Description of Artificial Sequence:  Enzymatic Nucleic Acid
agucgcaggccgaaaggcgagugaggucucacacagg

SEQ ID NO: 18420 - RNA, 37 nt, Artificial Sequence
  Description of Artificial Sequence:  Enzymatic Nucleic Acid
gagagucggccgaaaggcgagugaggucuagccacac

SEQ ID NO: 18421 - RNA, 37 nt, Artificial Sequence
  Description of Artificial Sequence:  Enzymatic Nucleic Acid
aauaggaggccgaaaggcgagugaggucucagaagag

SEQ ID NO: 18422 - RNA, 37 nt, Artificial Sequence
  Description of Artificial Sequence:  Enzymatic Nucleic Acid
gaagaagagccgaaaggcgagugaggucucuuuucau

SEQ ID NO: 18423 - RNA, 37 nt, Artificial Sequence
  Description of Artificial Sequence:  Enzymatic Nucleic Acid
caaaggaagccgaaaggcgagugaggucuuucaucug

SEQ ID NO: 18424 - RNA, 37 nt, Artificial Sequence
  Description of Artificial Sequence:  Enzymatic Nucleic Acid
ucacacuggccgaaaggcgagugaggucuucauccaa

SEQ ID NO: 18425 - RNA, 37 nt, Artificial Sequence
  Description of Artificial Sequence:  Enzymatic Nucleic Acid
cgcucacagccgaaaggcgagugaggucuugcucauc

SEQ ID NO: 18426 - RNA, 37 nt, Artificial Sequence
  Description of Artificial Sequence:  Enzymatic Nucleic Acid
gccgcucagccgaaaggcgagugaggucuacugcuca

SEQ ID NO: 18427 - RNA, 37 nt, Artificial Sequence
  Description of Artificial Sequence:  Enzymatic Nucleic Acid
gggagccggccgaaaggcgagugaggucuucacacug

SEQ ID NO: 18428 - RNA, 37 nt, Artificial Sequence
  Description of Artificial Sequence:  Enzymatic Nucleic Acid
uaagggaggccgaaaggcgagugaggucucgcucaca

SEQ ID NO: 18429 - RNA, 37 nt, Artificial Sequence
  Description of Artificial Sequence:  Enzymatic Nucleic Acid
cuugcugggccgaaaggcgagugaggucuaucauaag

SEQ ID NO: 18430 - RNA, 37 nt, Artificial Sequence
  Description of Artificial Sequence:  Enzymatic Nucleic Acid
cccacuuggccgaaaggcgagugaggucuuggcauca

SEQ ID NO: 18431 - RNA, 37 nt, Artificial Sequence
  Description of Artificial Sequence:  Enzymatic Nucleic Acid
aacucccagccgaaaggcgagugaggucuuugcuggc

SEQ ID NO: 18432 - RNA, 37 nt, Artificial Sequence
  Description of Artificial Sequence:  Enzymatic Nucleic Acid
cgggcaaagccgaaaggcgagugaggucuucccacuu

SEQ ID NO: 18433 - RNA, 37 nt, Artificial Sequence
  Description of Artificial Sequence:  Enzymatic Nucleic Acid
cucccggggccgaaaggcgagugaggucuaaacuccc

SEQ ID NO: 18434 - RNA, 37 nt, Artificial Sequence
  Description of Artificial Sequence:  Enzymatic Nucleic Acid
gugauuuggccgaaaggcgagugaggucuccaguuua

SEQ ID NO: 18435 - RNA, 37 nt, Artificial Sequence
  Description of Artificial Sequence:  Enzymatic Nucleic Acid
uccaaaaggccgaaaggcgagugaggucucccucuuc

SEQ ID NO: 18436 - RNA, 37 nt, Artificial Sequence
  Description of Artificial Sequence:  Enzymatic Nucleic Acid
uugaaccagccgaaaggcgagugaggucuuuuuccaa

SEQ ID NO: 18437 - RNA, 37 nt, Artificial Sequence
  Description of Artificial Sequence:  Enzymatic Nucleic Acid
ugcuugaagccgaaaggcgagugaggucucacuuuuc

SEQ ID NO: 18438 - RNA, 37 nt, Artificial Sequence
  Description of Artificial Sequence:  Enzymatic Nucleic Acid
ugcugauggccgaaaggcgagugaggucuuugaacca

SEQ ID NO: 18439 - RNA, 37 nt, Artificial Sequence
  Description of Artificial Sequence:  Enzymatic Nucleic Acid
gccaaauggccgaaaggcgagugaggucuugaugcuu

SEQ ID NO: 18440 - RNA, 37 nt, Artificial Sequence
  Description of Artificial Sequence:  Enzymatic Nucleic Acid
ucuuaauggccgaaaggcgagugaggucucaaaugcu

SEQ ID NO: 18441 - RNA, 37 nt, Artificial Sequence
  Description of Artificial Sequence:  Enzymatic Nucleic Acid
guccggcagccgaaaggcgagugaggucuguagguga

SEQ ID NO: 18442 - RNA, 37 nt, Artificial Sequence
  Description of Artificial Sequence:  Enzymatic Nucleic Acid
caguccgggccgaaaggcgagugaggucuacguaggu

SEQ ID NO: 18443 - RNA, 37 nt, Artificial Sequence
  Description of Artificial Sequence:  Enzymatic Nucleic Acid
cacagccagccgaaaggcgagugaggucuaguccggc

SEQ ID NO: 18444 - RNA, 37 nt, Artificial Sequence
  Description of Artificial Sequence:  Enzymatic Nucleic Acid
uuucacaggccgaaaggcgagugaggucucacagucc

SEQ ID NO: 18445 - RNA, 37 nt, Artificial Sequence
  Description of Artificial Sequence:  Enzymatic Nucleic Acid
cauuuucagccgaaaggcgagugaggucuagccacag

SEQ ID NO: 18446 - RNA, 37 nt, Artificial Sequence
  Description of Artificial Sequence:  Enzymatic Nucleic Acid
ucuuucaggccgaaaggcgagugaggucuauuuucac

SEQ ID NO: 18447 - RNA, 37 nt, Artificial Sequence
  Description of Artificial Sequence:  Enzymatic Nucleic Acid
ggccgugggccgaaaggcgagugaggucuccccucuu

SEQ ID NO: 18448 - RNA, 37 nt, Artificial Sequence
  Description of Artificial Sequence:  Enzymatic Nucleic Acid
cucgcugggccgaaaggcgagugaggucucguggccc

SEQ ID NO: 18449 - RNA, 37 nt, Artificial Sequence
  Description of Artificial Sequence:  Enzymatic Nucleic Acid
uguacucggccgaaaggcgagugaggucuuggccgug

SEQ ID NO: 18450 - RNA, 37 nt, Artificial Sequence
  Description of Artificial Sequence:  Enzymatic Nucleic Acid
gcuuuguagccgaaaggcgagugaggucuucgcuggc

SEQ ID NO: 18451 - RNA, 37 nt, Artificial Sequence
  Description of Artificial Sequence:  Enzymatic Nucleic Acid
caucagaggccgaaaggcgagugaggucuuuuguacu

SEQ ID NO: 18452 - RNA, 37 nt, Artificial Sequence
  Description of Artificial Sequence:  Enzymatic Nucleic Acid
auuuuuaggccgaaaggcgagugaggucuucagucau

SEQ ID NO: 18453 - RNA, 37 nt, Artificial Sequence
  Description of Artificial Sequence:  Enzymatic Nucleic Acid
gauggugggccgaaaggcgagugaggucucaaugugg

SEQ ID NO: 18454 - RNA, 37 nt, Artificial Sequence
  Description of Artificial Sequence:  Enzymatic Nucleic Acid
guuaaccagccgaaaggcgagugaggucuguucagau

SEQ ID NO: 18455 - RNA, 37 nt, Artificial Sequence
  Description of Artificial Sequence:  Enzymatic Nucleic Acid
cagguuaagccgaaaggcgagugaggucucacguuca

SEQ ID NO: 18456 - RNA, 37 nt, Artificial Sequence
  Description of Artificial Sequence:  Enzymatic Nucleic Acid
gcucccaggccgaaaggcgagugaggucuagguuaac

SEQ ID NO: 18457 - RNA, 37 nt, Artificial Sequence
  Description of Artificial Sequence:  Enzymatic Nucleic Acid
ggugcagggccgaaaggcgagugaggucuucccagca

SEQ ID NO: 18458 - RNA, 37 nt, Artificial Sequence
  Description of Artificial Sequence:  Enzymatic Nucleic Acid
gcuugguggccgaaaggcgagugaggucuaggcuccc

SEQ ID NO: 18459 - RNA, 37 nt, Artificial Sequence
  Description of Artificial Sequence:  Enzymatic Nucleic Acid
ccuccuuggccgaaaggcgagugaggucuuuggugca

SEQ ID NO: 18460 - RNA, 37 nt, Artificial Sequence
  Description of Artificial Sequence:  Enzymatic Nucleic Acid
aucagagggccgaaaggcgagugaggucuccuccuug

SEQ ID NO: 18461 - RNA, 37 nt, Artificial Sequence
  Description of Artificial Sequence:  Enzymatic Nucleic Acid
aacaaucagccgaaaggcgagugaggucucaucagag

SEQ ID NO: 18462 - RNA, 37 nt, Artificial Sequence
  Description of Artificial Sequence:  Enzymatic Nucleic Acid
guauucaagccgaaaggcgagugaggucuaaucacca

SEQ ID NO: 18463 - RNA, 37 nt, Artificial Sequence
  Description of Artificial Sequence:  Enzymatic Nucleic Acid
cauauuuggccgaaaggcgagugaggucuaguauuca

SEQ ID NO: 18464 - RNA, 37 nt, Artificial Sequence
  Description of Artificial Sequence:  Enzymatic Nucleic Acid
cacguuuggccgaaaggcgagugaggucuucuugagg

SEQ ID NO: 18465 - RNA, 37 nt, Artificial Sequence
  Description of Artificial Sequence:  Enzymatic Nucleic Acid
auaagucagccgaaaggcgagugaggucuguuugcuc

SEQ ID NO: 18466 - RNA, 37 nt, Artificial Sequence
  Description of Artificial Sequence:  Enzymatic Nucleic Acid
uagugcuggccgaaaggcgagugaggucuauccuugu

SEQ ID NO: 18467 - RNA, 37 nt, Artificial Sequence
  Description of Artificial Sequence:  Enzymatic Nucleic Acid
guguaguggccgaaaggcgagugaggucuugcauccu

SEQ ID NO: 18468 - RNA, 37 nt, Artificial Sequence
  Description of Artificial Sequence:  Enzymatic Nucleic Acid
uucuuagggccgaaaggcgagugaggucuuccaugug

SEQ ID NO: 18469 - RNA, 37 nt, Artificial Sequence
  Description of Artificial Sequence:  Enzymatic Nucleic Acid
aggccugggccgaaaggcgagugaggucuuccauuuu

SEQ ID NO: 18470 - RNA, 37 nt, Artificial Sequence
  Description of Artificial Sequence:  Enzymatic Nucleic Acid
guuccagggccgaaaggcgagugaggucucuggcucc

SEQ ID NO: 18471 - RNA, 37 nt, Artificial Sequence
  Description of Artificial Sequence:  Enzymatic Nucleic Acid
guuucuuggccgaaaggcgagugaggucucuuguucc

SEQ ID NO: 18472 - RNA, 37 nt, Artificial Sequence
  Description of Artificial Sequence:  Enzymatic Nucleic Acid
uggugacggccgaaaggcgagugaggucuuaucuagu

SEQ ID NO: 18473 - RNA, 37 nt, Artificial Sequence
  Description of Artificial Sequence:  Enzymatic Nucleic Acid
gcuggugagccgaaaggcgagugaggucugcuaucua

SEQ ID NO: 18474 - RNA, 37 nt, Artificial Sequence
  Description of Artificial Sequence:  Enzymatic Nucleic Acid
uuucgcuggccgaaaggcgagugaggucuuggugacg

SEQ ID NO: 18475 - RNA, 37 nt, Artificial Sequence
  Description of Artificial Sequence:  Enzymatic Nucleic Acid
agcuuucggccgaaaggcgagugaggucuugcuggug

SEQ ID NO: 18476 - RNA, 37 nt, Artificial Sequence
  Description of Artificial Sequence:  Enzymatic Nucleic Acid
ucgcaaaggccgaaaggcgagugaggucuuuucgcug

SEQ ID NO: 18477 - RNA, 37 nt, Artificial Sequence
  Description of Artificial Sequence:  Enzymatic Nucleic Acid
ggagcucggccgaaaggcgagugaggucuaaagcuuu

SEQ ID NO: 18478 - RNA, 37 nt, Artificial Sequence
  Description of Artificial Sequence:  Enzymatic Nucleic Acid
agccggaggccgaaaggcgagugaggucuucgcaaag

SEQ ID NO: 18479 - RNA, 37 nt, Artificial Sequence
  Description of Artificial Sequence:  Enzymatic Nucleic Acid
ccugaaaggccgaaaggcgagugaggucucggagcuc

SEQ ID NO: 18480 - RNA, 37 nt, Artificial Sequence
  Description of Artificial Sequence:  Enzymatic Nucleic Acid
cacucagagccgaaaggcgagugaggucuuuuuaucu

SEQ ID NO: 18481 - RNA, 37 nt, Artificial Sequence
  Description of Artificial Sequence:  Enzymatic Nucleic Acid
caacaucagccgaaaggcgagugaggucuucagacuu

SEQ ID NO: 18482 - RNA, 37 nt, Artificial Sequence
  Description of Artificial Sequence:  Enzymatic Nucleic Acid
uuccucaagccgaaaggcgagugaggucuaucacuca

SEQ ID NO: 18483 - RNA, 37 nt, Artificial Sequence
  Description of Artificial Sequence:  Enzymatic Nucleic Acid
uguagaaagccgaaaggcgagugaggucucgucagaa

SEQ ID NO: 18484 - RNA, 37 nt, Artificial Sequence
  Description of Artificial Sequence:  Enzymatic Nucleic Acid
gugauggggccgaaaggcgagugaggucuuccuugua

SEQ ID NO: 18485 - RNA, 37 nt, Artificial Sequence
  Description of Artificial Sequence:  Enzymatic Nucleic Acid
cuugaaaagccgaaaggcgagugaggucuuguaagaa

SEQ ID NO: 18486 - RNA, 37 nt, Artificial Sequence
  Description of Artificial Sequence:  Enzymatic Nucleic Acid
ucuggccagccgaaaggcgagugaggucuuugaaaac

SEQ ID NO: 18487 - RNA, 37 nt, Artificial Sequence
  Description of Artificial Sequence:  Enzymatic Nucleic Acid
gccucugggccgaaaggcgagugaggucucacuugaa

SEQ ID NO: 18488 - RNA, 37 nt, Artificial Sequence
  Description of Artificial Sequence:  Enzymatic Nucleic Acid
acuccauggccgaaaggcgagugaggucucucuggcc

SEQ ID NO: 18489 - RNA, 37 nt, Artificial Sequence
  Description of Artificial Sequence:  Enzymatic Nucleic Acid
gacaggaagccgaaaggcgagugaggucuuccaugcc

SEQ ID NO: 18490 - RNA, 37 nt, Artificial Sequence
  Description of Artificial Sequence:  Enzymatic Nucleic Acid
cuggaagagccgaaaggcgagugaggucuaggaacuc

SEQ ID NO: 18491 - RNA, 37 nt, Artificial Sequence
  Description of Artificial Sequence:  Enzymatic Nucleic Acid
ugaaugcagccgaaaggcgagugaggucuuuucugga

SEQ ID NO: 18492 - RNA, 37 nt, Artificial Sequence
  Description of Artificial Sequence:  Enzymatic Nucleic Acid
gaugaauggccgaaaggcgagugaggucuacuuucug

SEQ ID NO: 18493 - RNA, 37 nt, Artificial Sequence
  Description of Artificial Sequence:  Enzymatic Nucleic Acid
ucucgcuggccgaaaggcgagugaggucucagguccc

SEQ ID NO: 18494 - RNA, 37 nt, Artificial Sequence
  Description of Artificial Sequence:  Enzymatic Nucleic Acid
guuucucggccgaaaggcgagugaggucuugccaggu

SEQ ID NO: 18495 - RNA, 37 nt, Artificial Sequence
  Description of Artificial Sequence:  Enzymatic Nucleic Acid
cuucaccagccgaaaggcgagugaggucuguuguucu

SEQ ID NO: 18496 - RNA, 37 nt, Artificial Sequence
  Description of Artificial Sequence:  Enzymatic Nucleic Acid
aaucuucagccgaaaggcgagugaggucucacguugu

SEQ ID NO: 18497 - RNA, 37 nt, Artificial Sequence
  Description of Artificial Sequence:  Enzymatic Nucleic Acid
caaaaucagccgaaaggcgagugaggucuaaaucuuc

SEQ ID NO: 18498 - RNA, 37 nt, Artificial Sequence
  Description of Artificial Sequence:  Enzymatic Nucleic Acid
gggcaagggccgaaaggcgagugaggucucaaaauca

SEQ ID NO: 18499 - RNA, 37 nt, Artificial Sequence
  Description of Artificial Sequence:  Enzymatic Nucleic Acid
aucccggggccgaaaggcgagugaggucuaaggccaa

SEQ ID NO: 18500 - RNA, 37 nt, Artificial Sequence
  Description of Artificial Sequence:  Enzymatic Nucleic Acid
uuuucucagccgaaaggcgagugaggucuauaaucgg

SEQ ID NO: 18501 - RNA, 37 nt, Artificial Sequence
  Description of Artificial Sequence:  Enzymatic Nucleic Acid
uucgggaggccgaaaggcgagugaggucucauccauu

SEQ ID NO: 18502 - RNA, 37 nt, Artificial Sequence
  Description of Artificial Sequence:  Enzymatic Nucleic Acid
ucuugguggccgaaaggcgagugaggucuuguagauu

SEQ ID NO: 18503 - RNA, 37 nt, Artificial Sequence
  Description of Artificial Sequence:  Enzymatic Nucleic Acid
acacgucggccgaaaggcgagugaggucuucuuggug

SEQ ID NO: 18504 - RNA, 37 nt, Artificial Sequence
  Description of Artificial Sequence:  Enzymatic Nucleic Acid
agaccacagccgaaaggcgagugaggucugucgcucu

SEQ ID NO: 18505 - RNA, 37 nt, Artificial Sequence
  Description of Artificial Sequence:  Enzymatic Nucleic Acid
uaagaccagccgaaaggcgagugaggucuacgucgcu

SEQ ID NO: 18506 - RNA, 37 nt, Artificial Sequence
  Description of Artificial Sequence:  Enzymatic Nucleic Acid
ccguaagagccgaaaggcgagugaggucucacacguc

SEQ ID NO: 18507 - RNA, 37 nt, Artificial Sequence
  Description of Artificial Sequence:  Enzymatic Nucleic Acid
cagcaauagccgaaaggcgagugaggucuuccguaag

SEQ ID NO: 18508 - RNA, 37 nt, Artificial Sequence
  Description of Artificial Sequence:  Enzymatic Nucleic Acid
ucccacaggccgaaaggcgagugaggucuaauacucc

SEQ ID NO: 18509 - RNA, 37 nt, Artificial Sequence
  Description of Artificial Sequence:  Enzymatic Nucleic Acid
auuucccagccgaaaggcgagugaggucuagcaauac

SEQ ID NO: 18510 - RNA, 37 nt, Artificial Sequence
  Description of Artificial Sequence:  Enzymatic Nucleic Acid
gagacccagccgaaaggcgagugaggucucuaaggag

SEQ ID NO: 18511 - RNA, 37 nt, Artificial Sequence
  Description of Artificial Sequence:  Enzymatic Nucleic Acid
uauggagagccgaaaggcgagugaggucuccaccuaa

SEQ ID NO: 18512 - RNA, 37 nt, Artificial Sequence
  Description of Artificial Sequence:  Enzymatic Nucleic Acid
cauuuguagccgaaaggcgagugaggucuuccugggu

SEQ ID NO: 18513 - RNA, 37 nt, Artificial Sequence
  Description of Artificial Sequence:  Enzymatic Nucleic Acid
ggcgacuggccgaaaggcgagugaggucuaaaagucc

SEQ ID NO: 18514 - RNA, 37 nt, Artificial Sequence
  Description of Artificial Sequence:  Enzymatic Nucleic Acid
ucaggcgagccgaaaggcgagugaggucuugcaaaag

SEQ ID NO: 18515 - RNA, 37 nt, Artificial Sequence
  Description of Artificial Sequence:  Enzymatic Nucleic Acid
cccucagggccgaaaggcgagugaggucugacugcaa

SEQ ID NO: 18516 - RNA, 37 nt, Artificial Sequence
  Description of Artificial Sequence:  Enzymatic Nucleic Acid
uccucauggccgaaaggcgagugaggucucuucccuc

SEQ ID NO: 18517 - RNA, 37 nt, Artificial Sequence
  Description of Artificial Sequence:  Enzymatic Nucleic Acid
cucaggaggccgaaaggcgagugaggucuucucaucc

SEQ ID NO: 18518 - RNA, 37 nt, Artificial Sequence
  Description of Artificial Sequence:  Enzymatic Nucleic Acid
guagaguagccgaaaggcgagugaggucuucaggagc

SEQ ID NO: 18519 - RNA, 37 nt, Artificial Sequence
  Description of Artificial Sequence:  Enzymatic Nucleic Acid
caguccaggccgaaaggcgagugaggucuaugaucug

SEQ ID NO: 18520 - RNA, 37 nt, Artificial Sequence
  Description of Artificial Sequence:  Enzymatic Nucleic Acid
ugugccaggccgaaaggcgagugaggucuaguccagc

SEQ ID NO: 18521 - RNA, 37 nt, Artificial Sequence
  Description of Artificial Sequence:  Enzymatic Nucleic Acid
ucucuguggccgaaaggcgagugaggucucagcaguc

SEQ ID NO: 18522 - RNA, 37 nt, Artificial Sequence
  Description of Artificial Sequence:  Enzymatic Nucleic Acid
aaucuugggccgaaaggcgagugaggucucuuucuuu

SEQ ID NO: 18523 - RNA, 37 nt, Artificial Sequence
  Description of Artificial Sequence:  Enzymatic Nucleic Acid
aaguucuggccgaaaggcgagugaggucuaaaucuug

SEQ ID NO: 18524 - RNA, 37 nt, Artificial Sequence
  Description of Artificial Sequence:  Enzymatic Nucleic Acid
uuuuuccagccgaaaggcgagugaggucuaaguucug

SEQ ID NO: 18525 - RNA, 37 nt, Artificial Sequence
  Description of Artificial Sequence:  Enzymatic Nucleic Acid
gcaaaucagccgaaaggcgagugaggucucuaguuuu

SEQ ID NO: 18526 - RNA, 37 nt, Artificial Sequence
  Description of Artificial Sequence:  Enzymatic Nucleic Acid
gcuugaaggccgaaaggcgagugaggucuaaaucacc

SEQ ID NO: 18527 - RNA, 37 nt, Artificial Sequence
  Description of Artificial Sequence:  Enzymatic Nucleic Acid
uacauuuggccgaaaggcgagugaggucuuugaagca

SEQ ID NO: 18528 - RNA, 37 nt, Artificial Sequence
  Description of Artificial Sequence:  Enzymatic Nucleic Acid
cuguuguagccgaaaggcgagugaggucuauuugcuu

SEQ ID NO: 18529 - RNA, 37 nt, Artificial Sequence
  Description of Artificial Sequence:  Enzymatic Nucleic Acid
agucuuuagccgaaaggcgagugaggucucauccugu

SEQ ID NO: 18530 - RNA, 37 nt, Artificial Sequence
  Description of Artificial Sequence:  Enzymatic Nucleic Acid
caguaugggccgaaaggcgagugaggucuauugauug

SEQ ID NO: 18531 - RNA, 37 nt, Artificial Sequence
  Description of Artificial Sequence:  Enzymatic Nucleic Acid
uaaacccagccgaaaggcgagugaggucuuauuuccu

SEQ ID NO: 18532 - RNA, 37 nt, Artificial Sequence
  Description of Artificial Sequence:  Enzymatic Nucleic Acid
uauguaaagccgaaaggcgagugaggucuccacuauu

SEQ ID NO: 18533 - RNA, 37 nt, Artificial Sequence
  Description of Artificial Sequence:  Enzymatic Nucleic Acid
agagaagggccgaaaggcgagugaggucuaggaguug

SEQ ID NO: 18534 - RNA, 37 nt, Artificial Sequence
  Description of Artificial Sequence:  Enzymatic Nucleic Acid
cugaaauagccgaaaggcgagugaggucuuuuccuug

SEQ ID NO: 18535 - RNA, 37 nt, Artificial Sequence
  Description of Artificial Sequence:  Enzymatic Nucleic Acid
cuucggaggccgaaaggcgagugaggucuugaaauac

SEQ ID NO: 18536 - RNA, 37 nt, Artificial Sequence
  Description of Artificial Sequence:  Enzymatic Nucleic Acid
gaauuaaagccgaaaggcgagugaggucuuucggagc

SEQ ID NO: 18537 - RNA, 37 nt, Artificial Sequence
  Description of Artificial Sequence:  Enzymatic Nucleic Acid
caucagaggccgaaaggcgagugaggucuuuccugaa

SEQ ID NO: 18538 - RNA, 37 nt, Artificial Sequence
  Description of Artificial Sequence:  Enzymatic Nucleic Acid
auaucugagccgaaaggcgagugaggucuaucaucag

SEQ ID NO: 18539 - RNA, 37 nt, Artificial Sequence
  Description of Artificial Sequence:  Enzymatic Nucleic Acid
agcauuuagccgaaaggcgagugaggucuauaucuga

SEQ ID NO: 18540 - RNA, 37 nt, Artificial Sequence
  Description of Artificial Sequence:  Enzymatic Nucleic Acid
cuugaaaggccgaaaggcgagugaggucuauuuacau

SEQ ID NO: 18541 - RNA, 37 nt, Artificial Sequence
  Description of Artificial Sequence:  Enzymatic Nucleic Acid
cucaugaagccgaaaggcgagugaggucuuugaaagc

SEQ ID NO: 18542 - RNA, 37 nt, Artificial Sequence
  Description of Artificial Sequence:  Enzymatic Nucleic Acid
uuuccagggccgaaaggcgagugaggucuucaugaac

SEQ ID NO: 18543 - RNA, 37 nt, Artificial Sequence
  Description of Artificial Sequence:  Enzymatic Nucleic Acid
ggaggugggccgaaaggcgagugaggucuauucggua

SEQ ID NO: 18544 - RNA, 37 nt, Artificial Sequence
  Description of Artificial Sequence:  Enzymatic Nucleic Acid
ucaucaaagccgaaaggcgagugaggucuauggaggu

SEQ ID NO: 18545 - RNA, 37 nt, Artificial Sequence
  Description of Artificial Sequence:  Enzymatic Nucleic Acid
ugcugucggccgaaaggcgagugaggucuccugguag

SEQ ID NO: 18546 - RNA, 37 nt, Artificial Sequence
  Description of Artificial Sequence:  Enzymatic Nucleic Acid
gagugcuggccgaaaggcgagugaggucuugucgccc

SEQ ID NO: 18547 - RNA, 37 nt, Artificial Sequence
  Description of Artificial Sequence:  Enzymatic Nucleic Acid
acagaguggccgaaaggcgagugaggucuugcugucg

SEQ ID NO: 18548 - RNA, 37 nt, Artificial Sequence
  Description of Artificial Sequence:  Enzymatic Nucleic Acid
gaggccaagccgaaaggcgagugaggucuagagugcu

SEQ ID NO: 18549 - RNA, 37 nt, Artificial Sequence
  Description of Artificial Sequence:  Enzymatic Nucleic Acid
gggagagggccgaaaggcgagugaggucucaacagag

SEQ ID NO: 18550 - RNA, 37 nt, Artificial Sequence
  Description of Artificial Sequence:  Enzymatic Nucleic Acid
cgcuucaggccgaaaggcgagugaggucuaugggaga

SEQ ID NO: 18551 - RNA, 37 nt, Artificial Sequence
  Description of Artificial Sequence:  Enzymatic Nucleic Acid
gugaagcggccgaaaggcgagugaggucuuucagcau

SEQ ID NO: 18552 - RNA, 37 nt, Artificial Sequence
  Description of Artificial Sequence:  Enzymatic Nucleic Acid
aggugaaggccgaaaggcgagugaggucugcuucagc

SEQ ID NO: 18553 - RNA, 37 nt, Artificial Sequence
  Description of Artificial Sequence:  Enzymatic Nucleic Acid
uggguuuggccgaaaggcgagugaggucuugucaguc

SEQ ID NO: 18554 - RNA, 37 nt, Artificial Sequence
  Description of Artificial Sequence:  Enzymatic Nucleic Acid
gagcgagggccgaaaggcgagugaggucucuuggguu

SEQ ID NO: 18555 - RNA, 37 nt, Artificial Sequence
  Description of Artificial Sequence:  Enzymatic Nucleic Acid
aucuugaggccgaaaggcgagugaggucugaggccuu

SEQ ID NO: 18556 - RNA, 37 nt, Artificial Sequence
  Description of Artificial Sequence:  Enzymatic Nucleic Acid
acugguuagccgaaaggcgagugaggucuucucaagu

SEQ ID NO: 18557 - RNA, 37 nt, Artificial Sequence
  Description of Artificial Sequence:  Enzymatic Nucleic Acid
uacuuuuagccgaaaggcgagugaggucuugguuacu

SEQ ID NO: 18558 - RNA, 37 nt, Artificial Sequence
  Description of Artificial Sequence:  Enzymatic Nucleic Acid
acuccuuagccgaaaggcgagugaggucuuuuuacug

SEQ ID NO: 18559 - RNA, 37 nt, Artificial Sequence
  Description of Artificial Sequence:  Enzymatic Nucleic Acid
agccccgagccgaaaggcgagugaggucuuccuuacu

SEQ ID NO: 18560 - RNA, 37 nt, Artificial Sequence
  Description of Artificial Sequence:  Enzymatic Nucleic Acid
ucagacaggccgaaaggcgagugaggucucccgacuc

SEQ ID NO: 18561 - RNA, 37 nt, Artificial Sequence
  Description of Artificial Sequence:  Enzymatic Nucleic Acid
acaucagagccgaaaggcgagugaggucuagccccga

SEQ ID NO: 18562 - RNA, 37 nt, Artificial Sequence
  Description of Artificial Sequence:  Enzymatic Nucleic Acid
ccugcugagccgaaaggcgagugaggucuaucagaca

SEQ ID NO: 18563 - RNA, 37 nt, Artificial Sequence
  Description of Artificial Sequence:  Enzymatic Nucleic Acid
ugggccuggccgaaaggcgagugaggucuugacauca

SEQ ID NO: 18564 - RNA, 37 nt, Artificial Sequence
  Description of Artificial Sequence:  Enzymatic Nucleic Acid
aaacuggggccgaaaggcgagugaggucucugcugac

SEQ ID NO: 18565 - RNA, 37 nt, Artificial Sequence
  Description of Artificial Sequence:  Enzymatic Nucleic Acid
ggcagaaagccgaaaggcgagugaggucuugggccug

SEQ ID NO: 18566 - RNA, 37 nt, Artificial Sequence
  Description of Artificial Sequence:  Enzymatic Nucleic Acid
uggaaugggccgaaaggcgagugaggucuagaaacug

SEQ ID NO: 18567 - RNA, 37 nt, Artificial Sequence
  Description of Artificial Sequence:  Enzymatic Nucleic Acid
gcccacaggccgaaaggcgagugaggucuuggaaugg

SEQ ID NO: 18568 - RNA, 37 nt, Artificial Sequence
  Description of Artificial Sequence:  Enzymatic Nucleic Acid
cgugcccagccgaaaggcgagugaggucuagcuggaa

SEQ ID NO: 18569 - RNA, 37 nt, Artificial Sequence
  Description of Artificial Sequence:  Enzymatic Nucleic Acid
cugacguggccgaaaggcgagugaggucuccacagcu

SEQ ID NO: 18570 - RNA, 37 nt, Artificial Sequence
  Description of Artificial Sequence:  Enzymatic Nucleic Acid
uucgcugagccgaaaggcgagugaggucugugcccac

SEQ ID NO: 18571 - RNA, 37 nt, Artificial Sequence
  Description of Artificial Sequence:  Enzymatic Nucleic Acid
ugccuucggccgaaaggcgagugaggucuugacgugc

SEQ ID NO: 18572 - RNA, 37 nt, Artificial Sequence
  Description of Artificial Sequence:  Enzymatic Nucleic Acid
ugcgcuuggccgaaaggcgagugaggucucuucgcug

SEQ ID NO: 18573 - RNA, 37 nt, Artificial Sequence
  Description of Artificial Sequence:  Enzymatic Nucleic Acid
aaccugcggccgaaaggcgagugaggucuuugccuuc

SEQ ID NO: 18574 - RNA, 37 nt, Artificial Sequence
  Description of Artificial Sequence:  Enzymatic Nucleic Acid
ugaaccuggccgaaaggcgagugaggucugcuugccu

SEQ ID NO: 18575 - RNA, 37 nt, Artificial Sequence
  Description of Artificial Sequence:  Enzymatic Nucleic Acid
uaggugaagccgaaaggcgagugaggucucugcgcuu

SEQ ID NO: 18576 - RNA, 37 nt, Artificial Sequence
  Description of Artificial Sequence:  Enzymatic Nucleic Acid
cagcucaggccgaaaggcgagugaggucuguggucgu

SEQ ID NO: 18577 - RNA, 37 nt, Artificial Sequence
  Description of Artificial Sequence:  Enzymatic Nucleic Acid
cuuuccaggccgaaaggcgagugaggucuucagcgug

SEQ ID NO: 18578 - RNA, 37 nt, Artificial Sequence
  Description of Artificial Sequence:  Enzymatic Nucleic Acid
gcagcacggccgaaaggcgagugaggucugauuuucc

SEQ ID NO: 18579 - RNA, 37 nt, Artificial Sequence
  Description of Artificial Sequence:  Enzymatic Nucleic Acid
gagcagcagccgaaaggcgagugaggucugcgauuuu

SEQ ID NO: 18580 - RNA, 37 nt, Artificial Sequence
  Description of Artificial Sequence:  Enzymatic Nucleic Acid
gggagcaggccgaaaggcgagugaggucuacgcgauu

SEQ ID NO: 18581 - RNA, 37 nt, Artificial Sequence
  Description of Artificial Sequence:  Enzymatic Nucleic Acid
gcggggaggccgaaaggcgagugaggucuagcacgcg

SEQ ID NO: 18582 - RNA, 37 nt, Artificial Sequence
  Description of Artificial Sequence:  Enzymatic Nucleic Acid
ucuggggggccgaaaggcgagugaggucuggggagca

SEQ ID NO: 18583 - RNA, 37 nt, Artificial Sequence
  Description of Artificial Sequence:  Enzymatic Nucleic Acid
caggaccagccgaaaggcgagugaggucucgaguugu

SEQ ID NO: 18584 - RNA, 37 nt, Artificial Sequence
  Description of Artificial Sequence:  Enzymatic Nucleic Acid
guacaggagccgaaaggcgagugaggucucaccgagu

SEQ ID NO: 18585 - RNA, 37 nt, Artificial Sequence
  Description of Artificial Sequence:  Enzymatic Nucleic Acid
guggaguagccgaaaggcgagugaggucuaggaccac

SEQ ID NO: 18586 - RNA, 37 nt, Artificial Sequence
  Description of Artificial Sequence:  Enzymatic Nucleic Acid
gugucaaagccgaaaggcgagugaggucuucuagaug

SEQ ID NO: 18587 - RNA, 37 nt, Artificial Sequence
  Description of Artificial Sequence:  Enzymatic Nucleic Acid
aaauaagggccgaaaggcgagugaggucuuucguguc

SEQ ID NO: 18588 - RNA, 37 nt, Artificial Sequence
  Description of Artificial Sequence:  Enzymatic Nucleic Acid
cacauguggccgaaaggcgagugaggucuuucuagaa

SEQ ID NO: 18589 - RNA, 37 nt, Artificial Sequence
  Description of Artificial Sequence:  Enzymatic Nucleic Acid
uaaauacagccgaaaggcgagugaggucuaugugcuu

SEQ ID NO: 18590 - RNA, 37 nt, Artificial Sequence
  Description of Artificial Sequence:  Enzymatic Nucleic Acid
uauaaauagccgaaaggcgagugaggucuacaugugc

SEQ ID NO: 18591 - RNA, 37 nt, Artificial Sequence
  Description of Artificial Sequence:  Enzymatic Nucleic Acid
ggcaaaaggccgaaaggcgagugaggucuuaguuucc

SEQ ID NO: 18592 - RNA, 37 nt, Artificial Sequence
  Description of Artificial Sequence:  Enzymatic Nucleic Acid
aauacugggccgaaaggcgagugaggucuaaaagcua

SEQ ID NO: 18593 - RNA, 37 nt, Artificial Sequence
  Description of Artificial Sequence:  Enzymatic Nucleic Acid
gcauaauagccgaaaggcgagugaggucuuggcaaaa

SEQ ID NO: 18594 - RNA, 37 nt, Artificial Sequence
  Description of Artificial Sequence:  Enzymatic Nucleic Acid
uauauauggccgaaaggcgagugaggucuauaauacu

SEQ ID NO: 18595 - RNA, 37 nt, Artificial Sequence
  Description of Artificial Sequence:  Enzymatic Nucleic Acid
gguguaaagccgaaaggcgagugaggucuuuauauau

SEQ ID NO: 18596 - RNA, 37 nt, Artificial Sequence
  Description of Artificial Sequence:  Enzymatic Nucleic Acid
gcagcugggccgaaaggcgagugaggucuucccaugg

SEQ ID NO: 18597 - RNA, 37 nt, Artificial Sequence
  Description of Artificial Sequence:  Enzymatic Nucleic Acid
aaaagcaggccgaaaggcgagugaggucuuggcuccc

SEQ ID NO: 18598 - RNA, 37 nt, Artificial Sequence
  Description of Artificial Sequence:  Enzymatic Nucleic Acid
acaaaaaggccgaaaggcgagugaggucuagcuggcu

SEQ ID NO: 18599 - RNA, 37 nt, Artificial Sequence
  Description of Artificial Sequence:  Enzymatic Nucleic Acid
aaaaaucagccgaaaggcgagugaggucuaaaaagca

SEQ ID NO: 18600 - RNA, 37 nt, Artificial Sequence
  Description of Artificial Sequence:  Enzymatic Nucleic Acid
aaaaagcagccgaaaggcgagugaggucuuauuaaaa

SEQ ID NO: 18601 - RNA, 37 nt, Artificial Sequence
  Description of Artificial Sequence:  Enzymatic Nucleic Acid
aaaaaaaggccgaaaggcgagugaggucuacuauuaa

SEQ ID NO: 18602 - RNA, 37 nt, Artificial Sequence
  Description of Artificial Sequence:  Enzymatic Nucleic Acid
uggaguuagccgaaaggcgagugaggucuauucuugu

SEQ ID NO: 18603 - RNA, 37 nt, Artificial Sequence
  Description of Artificial Sequence:  Enzymatic Nucleic Acid
acuugucagccgaaaggcgagugaggucuuauuucuc

SEQ ID NO: 18604 - RNA, 37 nt, Artificial Sequence
  Description of Artificial Sequence:  Enzymatic Nucleic Acid
guucuucagccgaaaggcgagugaggucuuugucacu

SEQ ID NO: 18605 - RNA, 37 nt, Artificial Sequence
  Description of Artificial Sequence:  Enzymatic Nucleic Acid
ggauuuaggccgaaaggcgagugaggucuaguagugu

SEQ ID NO: 18606 - RNA, 37 nt, Artificial Sequence
  Description of Artificial Sequence:  Enzymatic Nucleic Acid
cugaguaagccgaaaggcgagugaggucuaugaggau

SEQ ID NO: 18607 - RNA, 37 nt, Artificial Sequence
  Description of Artificial Sequence:  Enzymatic Nucleic Acid
cucuaacagccgaaaggcgagugaggucuugaguaac

SEQ ID NO: 18608 - RNA, 37 nt, Artificial Sequence
  Description of Artificial Sequence:  Enzymatic Nucleic Acid
uucucuaagccgaaaggcgagugaggucuacugagua

SEQ ID NO: 18609 - RNA, 37 nt, Artificial Sequence
  Description of Artificial Sequence:  Enzymatic Nucleic Acid
gguuggaggccgaaaggcgagugaggucuagggaagu

SEQ ID NO: 18610 - RNA, 37 nt, Artificial Sequence
  Description of Artificial Sequence:  Enzymatic Nucleic Acid
ugaggugggccgaaaggcgagugaggucuggggguug

SEQ ID NO: 18611 - RNA, 37 nt, Artificial Sequence
  Description of Artificial Sequence:  Enzymatic Nucleic Acid
ccugcguggccgaaaggcgagugaggucuccugaggu

SEQ ID NO: 18612 - RNA, 37 nt, Artificial Sequence
  Description of Artificial Sequence:  Enzymatic Nucleic Acid
ugguccuggccgaaaggcgagugaggucugugcccug

SEQ ID NO: 18613 - RNA, 37 nt, Artificial Sequence
  Description of Artificial Sequence:  Enzymatic Nucleic Acid
caaucaaagccgaaaggcgagugaggucuugguccug

SEQ ID NO: 18614 - RNA, 37 nt, Artificial Sequence
  Description of Artificial Sequence:  Enzymatic Nucleic Acid
cagugcaggccgaaaggcgagugaggucuuccucaau

SEQ ID NO: 18615 - RNA, 37 nt, Artificial Sequence
  Description of Artificial Sequence:  Enzymatic Nucleic Acid
gaucaguggccgaaaggcgagugaggucuagcuccuc

SEQ ID NO: 18616 - RNA, 37 nt, Artificial Sequence
  Description of Artificial Sequence:  Enzymatic Nucleic Acid
acgugauggccgaaaggcgagugaggucuauugggug

SEQ ID NO: 18617 - RNA, 37 nt, Artificial Sequence
  Description of Artificial Sequence:  Enzymatic Nucleic Acid
gugggguagccgaaaggcgagugaggucugugaugca

SEQ ID NO: 18618 - RNA, 37 nt, Artificial Sequence
  Description of Artificial Sequence:  Enzymatic Nucleic Acid
agggcugggccgaaaggcgagugaggucuccaguggg

SEQ ID NO: 18619 - RNA, 37 nt, Artificial Sequence
  Description of Artificial Sequence:  Enzymatic Nucleic Acid
cugcaggggccgaaaggcgagugaggucuuggcccag

SEQ ID NO: 18620 - RNA, 37 nt, Artificial Sequence
  Description of Artificial Sequence:  Enzymatic Nucleic Acid
uugggcuggccgaaaggcgagugaggucuagggcugg

SEQ ID NO: 18621 - RNA, 37 nt, Artificial Sequence
  Description of Artificial Sequence:  Enzymatic Nucleic Acid
guuuuggggccgaaaggcgagugaggucuugcagggc

SEQ ID NO: 18622 - RNA, 37 nt, Artificial Sequence
  Description of Artificial Sequence:  Enzymatic Nucleic Acid
gcuuguuggccgaaaggcgagugaggucuccuggguu

SEQ ID NO: 18623 - RNA, 37 nt, Artificial Sequence
  Description of Artificial Sequence:  Enzymatic Nucleic Acid
cuaacggggccgaaaggcgagugaggucuuuguugcc

SEQ ID NO: 18624 - RNA, 37 nt, Artificial Sequence
  Description of Artificial Sequence:  Enzymatic Nucleic Acid
ggggcuaagccgaaaggcgagugaggucugggcuugu

SEQ ID NO: 18625 - RNA, 37 nt, Artificial Sequence
  Description of Artificial Sequence:  Enzymatic Nucleic Acid
cccugggggccgaaaggcgagugaggucuuaacgggc

SEQ ID NO: 18626 - RNA, 37 nt, Artificial Sequence
  Description of Artificial Sequence:  Enzymatic Nucleic Acid
caggccaggccgaaaggcgagugaggucucagugauc

SEQ ID NO: 18627 - RNA, 37 nt, Artificial Sequence
  Description of Artificial Sequence:  Enzymatic Nucleic Acid
ugcucagggccgaaaggcgagugaggucucagccagu

SEQ ID NO: 18628 - RNA, 37 nt, Artificial Sequence
  Description of Artificial Sequence:  Enzymatic Nucleic Acid
agauguuggccgaaaggcgagugaggucuucaggcca

SEQ ID NO: 18629 - RNA, 37 nt, Artificial Sequence
  Description of Artificial Sequence:  Enzymatic Nucleic Acid
cuagaggagccgaaaggcgagugaggucuucccgaga

SEQ ID NO: 18630 - RNA, 37 nt, Artificial Sequence
  Description of Artificial Sequence:  Enzymatic Nucleic Acid
uaggccuggccgaaaggcgagugaggucuuagaggac

SEQ ID NO: 18631 - RNA, 37 nt, Artificial Sequence
  Description of Artificial Sequence:  Enzymatic Nucleic Acid
gucuuagggccgaaaggcgagugaggucucugcuaga

SEQ ID NO: 18632 - RNA, 37 nt, Artificial Sequence
  Description of Artificial Sequence:  Enzymatic Nucleic Acid
ccuccucagccgaaaggcgagugaggucuaugucuua

SEQ ID NO: 18633 - RNA, 37 nt, Artificial Sequence
  Description of Artificial Sequence:  Enzymatic Nucleic Acid
gcuuuuuggccgaaaggcgagugaggucuuuuuuuuc

SEQ ID NO: 18634 - RNA, 37 nt, Artificial Sequence
  Description of Artificial Sequence:  Enzymatic Nucleic Acid
cucccuuggccgaaaggcgagugaggucuuuuuugcu

SEQ ID NO: 18635 - RNA, 37 nt, Artificial Sequence
  Description of Artificial Sequence:  Enzymatic Nucleic Acid
uucucauggccgaaaggcgagugaggucucuucuccc

SEQ ID NO: 18636 - RNA, 37 nt, Artificial Sequence
  Description of Artificial Sequence:  Enzymatic Nucleic Acid
acaugguggccgaaaggcgagugaggucugucucaaa

SEQ ID NO: 18637 - RNA, 37 nt, Artificial Sequence
  Description of Artificial Sequence:  Enzymatic Nucleic Acid
cgugcccagccgaaaggcgagugaggucuauggugcg

SEQ ID NO: 18638 - RNA, 37 nt, Artificial Sequence
  Description of Artificial Sequence:  Enzymatic Nucleic Acid
ccuccguggccgaaaggcgagugaggucuccacaugg

SEQ ID NO: 18639 - RNA, 37 nt, Artificial Sequence
  Description of Artificial Sequence:  Enzymatic Nucleic Acid
uugcugaggccgaaaggcgagugaggucucccguccc

SEQ ID NO: 18640 - RNA, 37 nt, Artificial Sequence
  Description of Artificial Sequence:  Enzymatic Nucleic Acid
uggcauuggccgaaaggcgagugaggucuugagcccc

SEQ ID NO: 18641 - RNA, 37 nt, Artificial Sequence
  Description of Artificial Sequence:  Enzymatic Nucleic Acid
ugaaaugggccgaaaggcgagugaggucuauugcuga

SEQ ID NO: 18642 - RNA, 37 nt, Artificial Sequence
  Description of Artificial Sequence:  Enzymatic Nucleic Acid
ggaagccagccgaaaggcgagugaggucuugaaaugg

SEQ ID NO: 18643 - RNA, 37 nt, Artificial Sequence
  Description of Artificial Sequence:  Enzymatic Nucleic Acid
cugggaaggccgaaaggcgagugaggucucacugaaa

SEQ ID NO: 18644 - RNA, 37 nt, Artificial Sequence
  Description of Artificial Sequence:  Enzymatic Nucleic Acid
ggucagaggccgaaaggcgagugaggucuugggaagc

SEQ ID NO: 18645 - RNA, 37 nt, Artificial Sequence
  Description of Artificial Sequence:  Enzymatic Nucleic Acid
uggcuggggccgaaaggcgagugaggucuccucaaau

SEQ ID NO: 18646 - RNA, 37 nt, Artificial Sequence
  Description of Artificial Sequence:  Enzymatic Nucleic Acid
gcuccugggccgaaaggcgagugaggucuugggcccu

SEQ ID NO: 18647 - RNA, 37 nt, Artificial Sequence
  Description of Artificial Sequence:  Enzymatic Nucleic Acid
uccaucuggccgaaaggcgagugaggucuuccuggcu

SEQ ID NO: 18648 - RNA, 37 nt, Artificial Sequence
  Description of Artificial Sequence:  Enzymatic Nucleic Acid
ccucaucggccgaaaggcgagugaggucuuguccauc

SEQ ID NO: 18649 - RNA, 37 nt, Artificial Sequence
  Description of Artificial Sequence:  Enzymatic Nucleic Acid
uuuucuuggccgaaaggcgagugaggucucucccaga

SEQ ID NO: 18650 - RNA, 37 nt, Artificial Sequence
  Description of Artificial Sequence:  Enzymatic Nucleic Acid
aaaauuuggccgaaaggcgagugaggucuuuuaguuc

SEQ ID NO: 18651 - RNA, 37 nt, Artificial Sequence
  Description of Artificial Sequence:  Enzymatic Nucleic Acid
uagaaccagccgaaaggcgagugaggucuuuccauag

SEQ ID NO: 18652 - RNA, 37 nt, Artificial Sequence
  Description of Artificial Sequence:  Enzymatic Nucleic Acid
acauagaagccgaaaggcgagugaggucucacuucca

SEQ ID NO: 18653 - RNA, 37 nt, Artificial Sequence
  Description of Artificial Sequence:  Enzymatic Nucleic Acid
agaauggagccgaaaggcgagugaggucuauagaacc

SEQ ID NO: 18654 - RNA, 37 nt, Artificial Sequence
  Description of Artificial Sequence:  Enzymatic Nucleic Acid
acaugccagccgaaaggcgagugaggucugaaugaga

SEQ ID NO: 18655 - RNA, 37 nt, Artificial Sequence
  Description of Artificial Sequence:  Enzymatic Nucleic Acid
aaaacauggccgaaaggcgagugaggucucacgaaug

SEQ ID NO: 18656 - RNA, 37 nt, Artificial Sequence
  Description of Artificial Sequence:  Enzymatic Nucleic Acid
aaucaaaagccgaaaggcgagugaggucuaugccacg

SEQ ID NO: 18657 - RNA, 37 nt, Artificial Sequence
  Description of Artificial Sequence:  Enzymatic Nucleic Acid
cagugcuagccgaaaggcgagugaggucuaaaucaaa

SEQ ID NO: 18658 - RNA, 37 nt, Artificial Sequence
  Description of Artificial Sequence:  Enzymatic Nucleic Acid
ccucaguggccgaaaggcgagugaggucuuacaaauc

SEQ ID NO: 18659 - RNA, 37 nt, Artificial Sequence
  Description of Artificial Sequence:  Enzymatic Nucleic Acid
gagugccagccgaaaggcgagugaggucuccucagug

SEQ ID NO: 18660 - RNA, 37 nt, Artificial Sequence
  Description of Artificial Sequence:  Enzymatic Nucleic Acid
guugaguggccgaaaggcgagugaggucucacccuca

SEQ ID NO: 18661 - RNA, 37 nt, Artificial Sequence
  Description of Artificial Sequence:  Enzymatic Nucleic Acid
aguauggggccgaaaggcgagugaggucuucagaguu

SEQ ID NO: 18662 - RNA, 37 nt, Artificial Sequence
  Description of Artificial Sequence:  Enzymatic Nucleic Acid
uagaggaggccgaaaggcgagugaggucucaaaagua

SEQ ID NO: 18663 - RNA, 37 nt, Artificial Sequence
  Description of Artificial Sequence:  Enzymatic Nucleic Acid
gcaucuuagccgaaaggcgagugaggucuuagaggag

SEQ ID NO: 18664 - RNA, 37 nt, Artificial Sequence
  Description of Artificial Sequence:  Enzymatic Nucleic Acid
uuucaguggccgaaaggcgagugaggucuaucuuacu

SEQ ID NO: 18665 - RNA, 37 nt, Artificial Sequence
  Description of Artificial Sequence:  Enzymatic Nucleic Acid
aacucugggccgaaaggcgagugaggucuuaaguuuu

SEQ ID NO: 18666 - RNA, 37 nt, Artificial Sequence
  Description of Artificial Sequence:  Enzymatic Nucleic Acid
caaccuaagccgaaaggcgagugaggucuucuggcua

SEQ ID NO: 18667 - RNA, 37 nt, Artificial Sequence
  Description of Artificial Sequence:  Enzymatic Nucleic Acid
ggagacaagccgaaaggcgagugaggucucuaacucu

SEQ ID NO: 18668 - RNA, 37 nt, Artificial Sequence
  Description of Artificial Sequence:  Enzymatic Nucleic Acid
ccuggagagccgaaaggcgagugaggucuaaccuaac

SEQ ID NO: 18669 - RNA, 37 nt, Artificial Sequence
  Description of Artificial Sequence:  Enzymatic Nucleic Acid
caucaugggccgaaaggcgagugaggucucuggagac

SEQ ID NO: 18670 - RNA, 37 nt, Artificial Sequence
  Description of Artificial Sequence:  Enzymatic Nucleic Acid
guguaagggccgaaaggcgagugaggucucaucaugg

SEQ ID NO: 18671 - RNA, 37 nt, Artificial Sequence
  Description of Artificial Sequence:  Enzymatic Nucleic Acid
gaaugugagccgaaaggcgagugaggucuauuuucag

SEQ ID NO: 18672 - RNA, 37 nt, Artificial Sequence
  Description of Artificial Sequence:  Enzymatic Nucleic Acid
uauuaauagccgaaaggcgagugaggucuccaaaaua

SEQ ID NO: 18673 - RNA, 37 nt, Artificial Sequence
  Description of Artificial Sequence:  Enzymatic Nucleic Acid
ugucuggagccgaaaggcgagugaggucuuauauauu

SEQ ID NO: 18674 - RNA, 37 nt, Artificial Sequence
  Description of Artificial Sequence:  Enzymatic Nucleic Acid
gaauaauagccgaaaggcgagugaggucucaagaaau

SEQ ID NO: 18675 - RNA, 37 nt, Artificial Sequence
  Description of Artificial Sequence:  Enzymatic Nucleic Acid
gugcaaaagccgaaaggcgagugaggucuagaauaau

SEQ ID NO: 18676 - RNA, 37 nt, Artificial Sequence
  Description of Artificial Sequence:  Enzymatic Nucleic Acid
uaacuguggccgaaaggcgagugaggucuaaaacaga

SEQ ID NO: 18677 - RNA, 37 nt, Artificial Sequence
  Description of Artificial Sequence:  Enzymatic Nucleic Acid
acaacuaagccgaaaggcgagugaggucuugugcaaa

SEQ ID NO: 18678 - RNA, 37 nt, Artificial Sequence
  Description of Artificial Sequence:  Enzymatic Nucleic Acid
uuucacaagccgaaaggcgagugaggucuuaacugug

SEQ ID NO: 18679 - RNA, 37 nt, Artificial Sequence
  Description of Artificial Sequence:  Enzymatic Nucleic Acid
uucuuucagccgaaaggcgagugaggucuaacuaacu

SEQ ID NO: 18680 - RNA, 37 nt, Artificial Sequence
  Description of Artificial Sequence:  Enzymatic Nucleic Acid
cuucucaggccgaaaggcgagugaggucuuuucuuuc

SEQ ID NO: 18681 - RNA, 37 nt, Artificial Sequence
  Description of Artificial Sequence:  Enzymatic Nucleic Acid
caggacuggccgaaaggcgagugaggucuauuuucau

SEQ ID NO: 18682 - RNA, 37 nt, Artificial Sequence
  Description of Artificial Sequence:  Enzymatic Nucleic Acid
ccucaggagccgaaaggcgagugaggucuugcauuuu

SEQ ID NO: 18683 - RNA, 37 nt, Artificial Sequence
  Description of Artificial Sequence:  Enzymatic Nucleic Acid
ggagaaaagccgaaaggcgagugaggucuucuccuca

SEQ ID NO: 18684 - RNA, 37 nt, Artificial Sequence
  Description of Artificial Sequence:  Enzymatic Nucleic Acid
uccaucaggccgaaaggcgagugaggucuccucguuu

SEQ ID NO: 18685 - RNA, 37 nt, Artificial Sequence
  Description of Artificial Sequence:  Enzymatic Nucleic Acid
cuuauugagccgaaaggcgagugaggucucuuuuucc

SEQ ID NO: 18686 - RNA, 37 nt, Artificial Sequence
  Description of Artificial Sequence:  Enzymatic Nucleic Acid
ucccuugagccgaaaggcgagugaggucucuuauuga

SEQ ID NO: 18687 - RNA, 37 nt, Artificial Sequence
  Description of Artificial Sequence:  Enzymatic Nucleic Acid
uauagagagccgaaaggcgagugaggucuggggucuu

SEQ ID NO: 18688 - RNA, 37 nt, Artificial Sequence
  Description of Artificial Sequence:  Enzymatic Nucleic Acid
ggucccaagccgaaaggcgagugaggucuuguguugg

SEQ ID NO: 18689 - RNA, 37 nt, Artificial Sequence
  Description of Artificial Sequence:  Enzymatic Nucleic Acid
gugacugagccgaaaggcgagugaggucuuuccugug

SEQ ID NO: 18690 - RNA, 37 nt, Artificial Sequence
  Description of Artificial Sequence:  Enzymatic Nucleic Acid
aaacgugagccgaaaggcgagugaggucuugacuucc

SEQ ID NO: 18691 - RNA, 37 nt, Artificial Sequence
  Description of Artificial Sequence:  Enzymatic Nucleic Acid
aaaggaaagccgaaaggcgagugaggucugugacuga

SEQ ID NO: 18692 - RNA, 37 nt, Artificial Sequence
  Description of Artificial Sequence:  Enzymatic Nucleic Acid
cucuuccagccgaaaggcgagugaggucuauccuuuc

SEQ ID NO: 18693 - RNA, 37 nt, Artificial Sequence
  Description of Artificial Sequence:  Enzymatic Nucleic Acid
agcuaauggccgaaaggcgagugaggucuucuuccac

SEQ ID NO: 18694 - RNA, 37 nt, Artificial Sequence
  Description of Artificial Sequence:  Enzymatic Nucleic Acid
ugcgccaggccgaaaggcgagugaggucuuaaugcuc

SEQ ID NO: 18695 - RNA, 37 nt, Artificial Sequence
  Description of Artificial Sequence:  Enzymatic Nucleic Acid
aauaugcggccgaaaggcgagugaggucucagcuaau

SEQ ID NO: 18696 - RNA, 37 nt, Artificial Sequence
  Description of Artificial Sequence:  Enzymatic Nucleic Acid
uuaauauggccgaaaggcgagugaggucugccagcua

SEQ ID NO: 18697 - RNA, 37 nt, Artificial Sequence
  Description of Artificial Sequence:  Enzymatic Nucleic Acid
uuaaaguggccgaaaggcgagugaggucuuuaauaug

SEQ ID NO: 18698 - RNA, 37 nt, Artificial Sequence
  Description of Artificial Sequence:  Enzymatic Nucleic Acid
ucaaggaggccgaaaggcgagugaggucuuuaaagug

SEQ ID NO: 18699 - RNA, 37 nt, Artificial Sequence
  Description of Artificial Sequence:  Enzymatic Nucleic Acid
ccuuuuuagccgaaaggcgagugaggucuucaaggag

SEQ ID NO: 18700 - RNA, 37 nt, Artificial Sequence
  Description of Artificial Sequence:  Enzymatic Nucleic Acid
acauaccagccgaaaggcgagugaggucucuuuuuac

SEQ ID NO: 18701 - RNA, 37 nt, Artificial Sequence
  Description of Artificial Sequence:  Enzymatic Nucleic Acid
auuacauagccgaaaggcgagugaggucucaccuuuu

SEQ ID NO: 18702 - RNA, 37 nt, Artificial Sequence
  Description of Artificial Sequence:  Enzymatic Nucleic Acid
auaaauuagccgaaaggcgagugaggucuauaccacc

SEQ ID NO: 18703 - RNA, 37 nt, Artificial Sequence
  Description of Artificial Sequence:  Enzymatic Nucleic Acid
auaccuuggccgaaaggcgagugaggucuauaaauua

SEQ ID NO: 18704 - RNA, 37 nt, Artificial Sequence
  Description of Artificial Sequence:  Enzymatic Nucleic Acid
gagaaauagccgaaaggcgagugaggucucuugcaua

SEQ ID NO: 18705 - RNA, 37 nt, Artificial Sequence
  Description of Artificial Sequence:  Enzymatic Nucleic Acid
agucccaagccgaaaggcgagugaggucuuggagaaa

SEQ ID NO: 18706 - RNA, 37 nt, Artificial Sequence
  Description of Artificial Sequence:  Enzymatic Nucleic Acid
cucauuaagccgaaaggcgagugaggucuuaauaucc

SEQ ID NO: 18707 - RNA, 37 nt, Artificial Sequence
  Description of Artificial Sequence:  Enzymatic Nucleic Acid
agugaugggccgaaaggcgagugaggucuucauuaac

SEQ ID NO: 18708 - RNA, 37 nt, Artificial Sequence
  Description of Artificial Sequence:  Enzymatic Nucleic Acid
aaaauggggccgaaaggcgagugaggucuuuuucuuc

SEQ ID NO: 18709 - RNA, 37 nt, Artificial Sequence
  Description of Artificial Sequence:  Enzymatic Nucleic Acid
uuucaaaggccgaaaggcgagugaggucuaguugaaa

SEQ ID NO: 18710 - RNA, 37 nt, Artificial Sequence
  Description of Artificial Sequence:  Enzymatic Nucleic Acid
accccagggccgaaaggcgagugaggucuaaguuuca

SEQ ID NO: 18711 - RNA, 37 nt, Artificial Sequence
  Description of Artificial Sequence:  Enzymatic Nucleic Acid
ugcucagagccgaaaggcgagugaggucucccaggca

SEQ ID NO: 18712 - RNA, 37 nt, Artificial Sequence
  Description of Artificial Sequence:  Enzymatic Nucleic Acid
ccaucauggccgaaaggcgagugaggucuucagaccc

SEQ ID NO: 18713 - RNA, 37 nt, Artificial Sequence
  Description of Artificial Sequence:  Enzymatic Nucleic Acid
cuuuccuagccgaaaggcgagugaggucuccugucuc

SEQ ID NO: 18714 - RNA, 37 nt, Artificial Sequence
  Description of Artificial Sequence:  Enzymatic Nucleic Acid
aguaggcggccgaaaggcgagugaggucuccuuuccu

SEQ ID NO: 18715 - RNA, 37 nt, Artificial Sequence
  Description of Artificial Sequence:  Enzymatic Nucleic Acid
agaguagggccgaaaggcgagugaggucugcccuuuc

SEQ ID NO: 18716 - RNA, 37 nt, Artificial Sequence
  Description of Artificial Sequence:  Enzymatic Nucleic Acid
ucuuuagagccgaaaggcgagugaggucuccugaaga

SEQ ID NO: 18717 - RNA, 37 nt, Artificial Sequence
  Description of Artificial Sequence:  Enzymatic Nucleic Acid
aaggcccagccgaaaggcgagugaggucuuugaucuu

SEQ ID NO: 18718 - RNA, 37 nt, Artificial Sequence
  Description of Artificial Sequence:  Enzymatic Nucleic Acid
auccaagggccgaaaggcgagugaggucuccacuuga

SEQ ID NO: 18719 - RNA, 37 nt, Artificial Sequence
  Description of Artificial Sequence:  Enzymatic Nucleic Acid
cagcuuaggccgaaaggcgagugaggucugauccaag

SEQ ID NO: 18720 - RNA, 37 nt, Artificial Sequence
  Description of Artificial Sequence:  Enzymatic Nucleic Acid
agagccaggccgaaaggcgagugaggucuuuagcgau

SEQ ID NO: 18721 - RNA, 37 nt, Artificial Sequence
  Description of Artificial Sequence:  Enzymatic Nucleic Acid
aaacagaggccgaaaggcgagugaggucucagcuuag

SEQ ID NO: 18722 - RNA, 37 nt, Artificial Sequence
  Description of Artificial Sequence:  Enzymatic Nucleic Acid
gcaucaaagccgaaaggcgagugaggucuagagccag

SEQ ID NO: 18723 - RNA, 37 nt, Artificial Sequence
  Description of Artificial Sequence:  Enzymatic Nucleic Acid
auaaauaggccgaaaggcgagugaggucuaucaaaca

SEQ ID NO: 18724 - RNA, 37 nt, Artificial Sequence
  Description of Artificial Sequence:  Enzymatic Nucleic Acid
cuaacuuggccgaaaggcgagugaggucuauaaauag

SEQ ID NO: 18725 - RNA, 37 nt, Artificial Sequence
  Description of Artificial Sequence:  Enzymatic Nucleic Acid
gacccuaagccgaaaggcgagugaggucuuugcauaa

SEQ ID NO: 18726 - RNA, 37 nt, Artificial Sequence
  Description of Artificial Sequence:  Enzymatic Nucleic Acid
uacauagagccgaaaggcgagugaggucuccuaacuu

SEQ ID NO: 18727 - RNA, 37 nt, Artificial Sequence
  Description of Artificial Sequence:  Enzymatic Nucleic Acid
ccuaaauagccgaaaggcgagugaggucuauagaccc

SEQ ID NO: 18728 - RNA, 37 nt, Artificial Sequence
  Description of Artificial Sequence:  Enzymatic Nucleic Acid
aguaggcggccgaaaggcgagugaggucuauccuaaa

SEQ ID NO: 18729 - RNA, 37 nt, Artificial Sequence
  Description of Artificial Sequence:  Enzymatic Nucleic Acid
agaguagggccgaaaggcgagugaggucugcauccua

SEQ ID NO: 18730 - RNA, 37 nt, Artificial Sequence
  Description of Artificial Sequence:  Enzymatic Nucleic Acid
ggugcagagccgaaaggcgagugaggucuauccuaaa

SEQ ID NO: 18731 - RNA, 37 nt, Artificial Sequence
  Description of Artificial Sequence:  Enzymatic Nucleic Acid
agaagguggccgaaaggcgagugaggucuagacaucc

SEQ ID NO: 18732 - RNA, 37 nt, Artificial Sequence
  Description of Artificial Sequence:  Enzymatic Nucleic Acid
acuggcuggccgaaaggcgagugaggucuagaaggug

SEQ ID NO: 18733 - RNA, 37 nt, Artificial Sequence
  Description of Artificial Sequence:  Enzymatic Nucleic Acid
cugacugggccgaaaggcgagugaggucuugcagaag

SEQ ID NO: 18734 - RNA, 37 nt, Artificial Sequence
  Description of Artificial Sequence:  Enzymatic Nucleic Acid
gcuucugagccgaaaggcgagugaggucuuggcugca

SEQ ID NO: 18735 - RNA, 37 nt, Artificial Sequence
  Description of Artificial Sequence:  Enzymatic Nucleic Acid
cucuccaggccgaaaggcgagugaggucuuucugacu

SEQ ID NO: 18736 - RNA, 37 nt, Artificial Sequence
  Description of Artificial Sequence:  Enzymatic Nucleic Acid
cacuguuggccgaaaggcgagugaggucucucuccag

SEQ ID NO: 18737 - RNA, 37 nt, Artificial Sequence
  Description of Artificial Sequence:  Enzymatic Nucleic Acid
gcaauccagccgaaaggcgagugaggucuuguugccu

SEQ ID NO: 18738 - RNA, 37 nt, Artificial Sequence
  Description of Artificial Sequence:  Enzymatic Nucleic Acid
agaagcaggccgaaaggcgagugaggucuaauccacu

SEQ ID NO: 18739 - RNA, 37 nt, Artificial Sequence
  Description of Artificial Sequence:  Enzymatic Nucleic Acid
ccaagaaggccgaaaggcgagugaggucuagcaaucc

SEQ ID NO: 18740 - RNA, 37 nt, Artificial Sequence
  Description of Artificial Sequence:  Enzymatic Nucleic Acid
gaagcauagccgaaaggcgagugaggucuucuucucc

SEQ ID NO: 18741 - RNA, 37 nt, Artificial Sequence
  Description of Artificial Sequence:  Enzymatic Nucleic Acid
aaaggaaggccgaaaggcgagugaggucuauacucuu

SEQ ID NO: 18742 - RNA, 37 nt, Artificial Sequence
  Description of Artificial Sequence:  Enzymatic Nucleic Acid
uuaaauuagccgaaaggcgagugaggucuauggauaa

SEQ ID NO: 18743 - RNA, 37 nt, Artificial Sequence
  Description of Artificial Sequence:  Enzymatic Nucleic Acid
agguucuagccgaaaggcgagugaggucuaguuaaau

SEQ ID NO: 18744 - RNA, 37 nt, Artificial Sequence
  Description of Artificial Sequence:  Enzymatic Nucleic Acid
acuuagaggccgaaaggcgagugaggucuucagguuc

SEQ ID NO: 18745 - RNA, 37 nt, Artificial Sequence
  Description of Artificial Sequence:  Enzymatic Nucleic Acid
uucgguuagccgaaaggcgagugaggucuuuagagcu

SEQ ID NO: 18746 - RNA, 37 nt, Artificial Sequence
  Description of Artificial Sequence:  Enzymatic Nucleic Acid
gaggcauagccgaaaggcgagugaggucuauucuucg

SEQ ID NO: 18747 - RNA, 37 nt, Artificial Sequence
  Description of Artificial Sequence:  Enzymatic Nucleic Acid
aacagagggccgaaaggcgagugaggucuauacauuc

SEQ ID NO: 18748 - RNA, 37 nt, Artificial Sequence
  Description of Artificial Sequence:  Enzymatic Nucleic Acid
cauaagaagccgaaaggcgagugaggucuagaggcau

SEQ ID NO: 18749 - RNA, 37 nt, Artificial Sequence
  Description of Artificial Sequence:  Enzymatic Nucleic Acid
auguggcagccgaaaggcgagugaggucuauaagaac

SEQ ID NO: 18750 - RNA, 37 nt, Artificial Sequence
  Description of Artificial Sequence:  Enzymatic Nucleic Acid
ggaugugggccgaaaggcgagugaggucuacauaaga

SEQ ID NO: 18751 - RNA, 37 nt, Artificial Sequence
  Description of Artificial Sequence:  Enzymatic Nucleic Acid
ccuuuaaagccgaaaggcgagugaggucuaaggaugu

SEQ ID NO: 18752 - RNA, 37 nt, Artificial Sequence
  Description of Artificial Sequence:  Enzymatic Nucleic Acid
acagagaggccgaaaggcgagugaggucucuuuaaac

SEQ ID NO: 18753 - RNA, 37 nt, Artificial Sequence
  Description of Artificial Sequence:  Enzymatic Nucleic Acid
ucuucauagccgaaaggcgagugaggucuagagagcc

SEQ ID NO: 18754 - RNA, 37 nt, Artificial Sequence
  Description of Artificial Sequence:  Enzymatic Nucleic Acid
gcugaugagccgaaaggcgagugaggucuggucccau

SEQ ID NO: 18755 - RNA, 37 nt, Artificial Sequence
  Description of Artificial Sequence:  Enzymatic Nucleic Acid
ggaauguggccgaaaggcgagugaggucuugaugacg

SEQ ID NO: 18756 - RNA, 37 nt, Artificial Sequence
  Description of Artificial Sequence:  Enzymatic Nucleic Acid
uaggcucagccgaaaggcgagugaggucuuagggaau

SEQ ID NO: 18757 - RNA, 37 nt, Artificial Sequence
  Description of Artificial Sequence:  Enzymatic Nucleic Acid
ccaguagggccgaaaggcgagugaggucuucacuagg

SEQ ID NO: 18758 - RNA, 37 nt, Artificial Sequence
  Description of Artificial Sequence:  Enzymatic Nucleic Acid
gccaggaggccgaaaggcgagugaggucucaguaggc

SEQ ID NO: 18759 - RNA, 37 nt, Artificial Sequence
  Description of Artificial Sequence:  Enzymatic Nucleic Acid
agccgcuggccgaaaggcgagugaggucucaggagcc

SEQ ID NO: 18760 - RNA, 37 nt, Artificial Sequence
  Description of Artificial Sequence:  Enzymatic Nucleic Acid
aaaagccggccgaaaggcgagugaggucuugccagga

SEQ ID NO: 18761 - RNA, 37 nt, Artificial Sequence
  Description of Artificial Sequence:  Enzymatic Nucleic Acid
cacaaaaggccgaaaggcgagugaggucucgcugcca

SEQ ID NO: 18762 - RNA, 37 nt, Artificial Sequence
  Description of Artificial Sequence:  Enzymatic Nucleic Acid
gucuuccagccgaaaggcgagugaggucuaaaagccg

SEQ ID NO: 18763 - RNA, 37 nt, Artificial Sequence
  Description of Artificial Sequence:  Enzymatic Nucleic Acid
ucuucugggccgaaaggcgagugaggucuuagugagu

SEQ ID NO: 18764 - RNA, 37 nt, Artificial Sequence
  Description of Artificial Sequence:  Enzymatic Nucleic Acid
cugucccagccgaaaggcgagugaggucuuccucucu

SEQ ID NO: 18765 - RNA, 37 nt, Artificial Sequence
  Description of Artificial Sequence:  Enzymatic Nucleic Acid
ggagaggagccgaaaggcgagugaggucuugucccac

SEQ ID NO: 18766 - RNA, 37 nt, Artificial Sequence
  Description of Artificial Sequence:  Enzymatic Nucleic Acid
cuagccuggccgaaaggcgagugaggucuuuuuguuu

SEQ ID NO: 18767 - RNA, 37 nt, Artificial Sequence
  Description of Artificial Sequence:  Enzymatic Nucleic Acid
ggcucuaggccgaaaggcgagugaggucucugcuuuu

SEQ ID NO: 18768 - RNA, 37 nt, Artificial Sequence
  Description of Artificial Sequence:  Enzymatic Nucleic Acid
ucuucugggccgaaaggcgagugaggucuucuagccu

SEQ ID NO: 18769 - RNA, 37 nt, Artificial Sequence
  Description of Artificial Sequence:  Enzymatic Nucleic Acid
aggaacaagccgaaaggcgagugaggucuaaagauuu

SEQ ID NO: 18770 - RNA, 37 nt, Artificial Sequence
  Description of Artificial Sequence:  Enzymatic Nucleic Acid
aagaggaagccgaaaggcgagugaggucuaacaaaga

SEQ ID NO: 18771 - RNA, 37 nt, Artificial Sequence
  Description of Artificial Sequence:  Enzymatic Nucleic Acid
gugguuuggccgaaaggcgagugaggucuguaugugu

SEQ ID NO: 18772 - RNA, 37 nt, Artificial Sequence
  Description of Artificial Sequence:  Enzymatic Nucleic Acid
agcugucagccgaaaggcgagugaggucuaggugguu

SEQ ID NO: 18773 - RNA, 37 nt, Artificial Sequence
  Description of Artificial Sequence:  Enzymatic Nucleic Acid
auugccaggccgaaaggcgagugaggucuugucacag

SEQ ID NO: 18774 - RNA, 37 nt, Artificial Sequence
  Description of Artificial Sequence:  Enzymatic Nucleic Acid
uaaaauuggccgaaaggcgagugaggucucagcuguc

SEQ ID NO: 18775 - RNA, 37 nt, Artificial Sequence
  Description of Artificial Sequence:  Enzymatic Nucleic Acid
uccaguuagccgaaaggcgagugaggucucugauuua

SEQ ID NO: 18776 - RNA, 37 nt, Artificial Sequence
  Description of Artificial Sequence:  Enzymatic Nucleic Acid
gaguuuaagccgaaaggcgagugaggucucuccuucc

SEQ ID NO: 18777 - RNA, 37 nt, Artificial Sequence
  Description of Artificial Sequence:  Enzymatic Nucleic Acid
agaauugagccgaaaggcgagugaggucuugaggucu

SEQ ID NO: 18778 - RNA, 37 nt, Artificial Sequence
  Description of Artificial Sequence:  Enzymatic Nucleic Acid
uugcuggggccgaaaggcgagugaggucuuauuaucu

SEQ ID NO: 18779 - RNA, 37 nt, Artificial Sequence
  Description of Artificial Sequence:  Enzymatic Nucleic Acid
acuauuuggccgaaaggcgagugaggucuugggcuau

SEQ ID NO: 18780 - RNA, 37 nt, Artificial Sequence
  Description of Artificial Sequence:  Enzymatic Nucleic Acid
uguuaucagccgaaaggcgagugaggucuuauuugcu

SEQ ID NO: 18781 - RNA, 37 nt, Artificial Sequence
  Description of Artificial Sequence:  Enzymatic Nucleic Acid
augaacaggccgaaaggcgagugaggucuuaagguuu

SEQ ID NO: 18782 - RNA, 37 nt, Artificial Sequence
  Description of Artificial Sequence:  Enzymatic Nucleic Acid
gacaugaagccgaaaggcgagugaggucuagcuaagg

SEQ ID NO: 18783 - RNA, 37 nt, Artificial Sequence
  Description of Artificial Sequence:  Enzymatic Nucleic Acid
aaucaagagccgaaaggcgagugaggucuaugaacag

SEQ ID NO: 18784 - RNA, 37 nt, Artificial Sequence
  Description of Artificial Sequence:  Enzymatic Nucleic Acid
ugguuuuggccgaaaggcgagugaggucuuuuucucu

SEQ ID NO: 18785 - RNA, 37 nt, Artificial Sequence
  Description of Artificial Sequence:  Enzymatic Nucleic Acid
cugaguaagccgaaaggcgagugaggucuaauucuaa

SEQ ID NO: 18786 - RNA, 37 nt, Artificial Sequence
  Description of Artificial Sequence:  Enzymatic Nucleic Acid
ugaaggaggccgaaaggcgagugaggucuugaguaac

SEQ ID NO: 18787 - RNA, 37 nt, Artificial Sequence
  Description of Artificial Sequence:  Enzymatic Nucleic Acid
gcuacaaagccgaaaggcgagugaggucucugaguuu

SEQ ID NO: 18788 - RNA, 37 nt, Artificial Sequence
  Description of Artificial Sequence:  Enzymatic Nucleic Acid
guaugcuagccgaaaggcgagugaggucuaaaccuga

SEQ ID NO: 18789 - RNA, 37 nt, Artificial Sequence
  Description of Artificial Sequence:  Enzymatic Nucleic Acid
cauguauggccgaaaggcgagugaggucuuacaaacc

SEQ ID NO: 18790 - RNA, 37 nt, Artificial Sequence
  Description of Artificial Sequence:  Enzymatic Nucleic Acid
uggauggagccgaaaggcgagugaggucuucauguau

SEQ ID NO: 18791 - RNA, 37 nt, Artificial Sequence
  Description of Artificial Sequence:  Enzymatic Nucleic Acid
uucuuugagccgaaaggcgagugaggucuugauggau

SEQ ID NO: 18792 - RNA, 37 nt, Artificial Sequence
  Description of Artificial Sequence:  Enzymatic Nucleic Acid
agauggaagccgaaaggcgagugaggucucauucuuu

SEQ ID NO: 18793 - RNA, 37 nt, Artificial Sequence
  Description of Artificial Sequence:  Enzymatic Nucleic Acid
cauuaagagccgaaaggcgagugaggucuuccagaug

SEQ ID NO: 18794 - RNA, 37 nt, Artificial Sequence
  Description of Artificial Sequence:  Enzymatic Nucleic Acid
ucuuucuagccgaaaggcgagugaggucuauuaagac

SEQ ID NO: 18795 - RNA, 37 nt, Artificial Sequence
  Description of Artificial Sequence:  Enzymatic Nucleic Acid
cauuauuagccgaaaggcgagugaggucuaagucucc

SEQ ID NO: 18796 - RNA, 37 nt, Artificial Sequence
  Description of Artificial Sequence:  Enzymatic Nucleic Acid
guaacuaggccgaaaggcgagugaggucuucauuauu

SEQ ID NO: 18797 - RNA, 37 nt, Artificial Sequence
  Description of Artificial Sequence:  Enzymatic Nucleic Acid
cuuuguaagccgaaaggcgagugaggucuuagcucau

SEQ ID NO: 18798 - RNA, 37 nt, Artificial Sequence
  Description of Artificial Sequence:  Enzymatic Nucleic Acid
aacaagcagccgaaaggcgagugaggucuuuuguaac

SEQ ID NO: 18799 - RNA, 37 nt, Artificial Sequence
  Description of Artificial Sequence:  Enzymatic Nucleic Acid
ugaacaaggccgaaaggcgagugaggucuacuuugua

SEQ ID NO: 18800 - RNA, 37 nt, Artificial Sequence
  Description of Artificial Sequence:  Enzymatic Nucleic Acid
uuaaugaagccgaaaggcgagugaggucuaagcacuu

SEQ ID NO: 18801 - RNA, 37 nt, Artificial Sequence
  Description of Artificial Sequence:  Enzymatic Nucleic Acid
uuucaguggccgaaaggcgagugaggucuuauuuuaa

SEQ ID NO: 18802 - RNA, 37 nt, Artificial Sequence
  Description of Artificial Sequence:  Enzymatic Nucleic Acid
auaaaugggccgaaaggcgagugaggucuaaaugauu

SEQ ID NO: 18803 - RNA, 37 nt, Artificial Sequence
  Description of Artificial Sequence:  Enzymatic Nucleic Acid
agugccaagccgaaaggcgagugaggucucauuuuug

SEQ ID NO: 18804 - RNA, 37 nt, Artificial Sequence
  Description of Artificial Sequence:  Enzymatic Nucleic Acid
uguuaguggccgaaaggcgagugaggucucaaccauu

SEQ ID NO: 18805 - RNA, 37 nt, Artificial Sequence
  Description of Artificial Sequence:  Enzymatic Nucleic Acid
aggaaguggccgaaaggcgagugaggucuucguucuu

SEQ ID NO: 18806 - RNA, 37 nt, Artificial Sequence
  Description of Artificial Sequence:  Enzymatic Nucleic Acid
cucagaaagccgaaaggcgagugaggucuucugaaag

SEQ ID NO: 18807 - RNA, 37 nt, Artificial Sequence
  Description of Artificial Sequence:  Enzymatic Nucleic Acid
uccacguagccgaaaggcgagugaggucuauuaucuc

SEQ ID NO: 18808 - RNA, 37 nt, Artificial Sequence
  Description of Artificial Sequence:  Enzymatic Nucleic Acid
cuguuccagccgaaaggcgagugaggucuguacauua

SEQ ID NO: 18809 - RNA, 37 nt, Artificial Sequence
  Description of Artificial Sequence:  Enzymatic Nucleic Acid
cacccagagccgaaaggcgagugaggucuuguuccac

SEQ ID NO: 18810 - RNA, 37 nt, Artificial Sequence
  Description of Artificial Sequence:  Enzymatic Nucleic Acid
ccauuccagccgaaaggcgagugaggucuccagacug

SEQ ID NO: 18811 - RNA, 37 nt, Artificial Sequence
  Description of Artificial Sequence:  Enzymatic Nucleic Acid
gguuucaggccgaaaggcgagugaggucucccauucc

SEQ ID NO: 18812 - RNA, 37 nt, Artificial Sequence
  Description of Artificial Sequence:  Enzymatic Nucleic Acid
gacuugcagccgaaaggcgagugaggucuaugguuuc

SEQ ID NO: 18813 - RNA, 37 nt, Artificial Sequence
  Description of Artificial Sequence:  Enzymatic Nucleic Acid
cagacuuggccgaaaggcgagugaggucuacaugguu

SEQ ID NO: 18814 - RNA, 37 nt, Artificial Sequence
  Description of Artificial Sequence:  Enzymatic Nucleic Acid
gacacagagccgaaaggcgagugaggucuuugcacau

SEQ ID NO: 18815 - RNA, 37 nt, Artificial Sequence
  Description of Artificial Sequence:  Enzymatic Nucleic Acid
acaagacagccgaaaggcgagugaggucuagacuugc

SEQ ID NO: 18816 - RNA, 37 nt, Artificial Sequence
  Description of Artificial Sequence:  Enzymatic Nucleic Acid
ugacaagagccgaaaggcgagugaggucuacagacuu

SEQ ID NO: 18817 - RNA, 37 nt, Artificial Sequence
  Description of Artificial Sequence:  Enzymatic Nucleic Acid
uggacugagccgaaaggcgagugaggucuaagacaca

SEQ ID NO: 18818 - RNA, 37 nt, Artificial Sequence
  Description of Artificial Sequence:  Enzymatic Nucleic Acid
uucuuggagccgaaaggcgagugaggucuugacaaga

SEQ ID NO: 18819 - RNA, 37 nt, Artificial Sequence
  Description of Artificial Sequence:  Enzymatic Nucleic Acid
cggugucagccgaaaggcgagugaggucuuucuugga

SEQ ID NO: 18820 - RNA, 37 nt, Artificial Sequence
  Description of Artificial Sequence:  Enzymatic Nucleic Acid
aaaauuaagccgaaaggcgagugaggucuaucucggu

SEQ ID NO: 18821 - RNA, 37 nt, Artificial Sequence
  Description of Artificial Sequence:  Enzymatic Nucleic Acid
acaaggcagccgaaaggcgagugaggucugggucccu

SEQ ID NO: 18822 - RNA, 37 nt, Artificial Sequence
  Description of Artificial Sequence:  Enzymatic Nucleic Acid
aaacaagggccgaaaggcgagugaggucuacgggucc

SEQ ID NO: 18823 - RNA, 37 nt, Artificial Sequence
  Description of Artificial Sequence:  Enzymatic Nucleic Acid
cuaggaaagccgaaaggcgagugaggucuaaggcacg

SEQ ID NO: 18824 - RNA, 37 nt, Artificial Sequence
  Description of Artificial Sequence:  Enzymatic Nucleic Acid
cuuguggggccgaaaggcgagugaggucuuaggaaac

SEQ ID NO: 18825 - RNA, 37 nt, Artificial Sequence
  Description of Artificial Sequence:  Enzymatic Nucleic Acid
gauguuuggccgaaaggcgagugaggucuauucuugu

SEQ ID NO: 18826 - RNA, 37 nt, Artificial Sequence
  Description of Artificial Sequence:  Enzymatic Nucleic Acid
gaggcuaggccgaaaggcgagugaggucugaguaucu

SEQ ID NO: 18827 - RNA, 37 nt, Artificial Sequence
  Description of Artificial Sequence:  Enzymatic Nucleic Acid
aaaugagggccgaaaggcgagugaggucuuagcgagu

SEQ ID NO: 18828 - RNA, 37 nt, Artificial Sequence
  Description of Artificial Sequence:  Enzymatic Nucleic Acid
aagaugcagccgaaaggcgagugaggucuuccuccuu

SEQ ID NO: 18829 - RNA, 37 nt, Artificial Sequence
  Description of Artificial Sequence:  Enzymatic Nucleic Acid
caaagauggccgaaaggcgagugaggucuacuccucc

SEQ ID NO: 18830 - RNA, 37 nt, Artificial Sequence
  Description of Artificial Sequence:  Enzymatic Nucleic Acid
acugucgggccgaaaggcgagugaggucucaaagaug

SEQ ID NO: 18831 - RNA, 37 nt, Artificial Sequence
  Description of Artificial Sequence:  Enzymatic Nucleic Acid
uuacaccagccgaaaggcgagugaggucuugucggcc

SEQ ID NO: 18832 - RNA, 37 nt, Artificial Sequence
  Description of Artificial Sequence:  Enzymatic Nucleic Acid
caguuacagccgaaaggcgagugaggucucacugucg

SEQ ID NO: 18833 - RNA, 37 nt, Artificial Sequence
  Description of Artificial Sequence:  Enzymatic Nucleic Acid
cacaguuagccgaaaggcgagugaggucuaccacugu

SEQ ID NO: 18834 - RNA, 37 nt, Artificial Sequence
  Description of Artificial Sequence:  Enzymatic Nucleic Acid
cacacacagccgaaaggcgagugaggucuaguuacac

SEQ ID NO: 18835 - RNA, 37 nt, Artificial Sequence
  Description of Artificial Sequence:  Enzymatic Nucleic Acid
cacacacagccgaaaggcgagugaggucuacaguuac

SEQ ID NO: 18836 - RNA, 37 nt, Artificial Sequence
  Description of Artificial Sequence:  Enzymatic Nucleic Acid
cacacacagccgaaaggcgagugaggucuacacaguu

SEQ ID NO: 18837 - RNA, 37 nt, Artificial Sequence
  Description of Artificial Sequence:  Enzymatic Nucleic Acid
cacacacagccgaaaggcgagugaggucuacacacag

SEQ ID NO: 18838 - RNA, 37 nt, Artificial Sequence
  Description of Artificial Sequence:  Enzymatic Nucleic Acid
cacacacagccgaaaggcgagugaggucuacacacac

SEQ ID NO: 18839 - RNA, 37 nt, Artificial Sequence
  Description of Artificial Sequence:  Enzymatic Nucleic Acid
cccacacagccgaaaggcgagugaggucuacacacac

SEQ ID NO: 18840 - RNA, 37 nt, Artificial Sequence
  Description of Artificial Sequence:  Enzymatic Nucleic Acid
cacccacagccgaaaggcgagugaggucuacacacac

SEQ ID NO: 18841 - RNA, 37 nt, Artificial Sequence
  Description of Artificial Sequence:  Enzymatic Nucleic Acid
cacacccagccgaaaggcgagugaggucuacacacac

SEQ ID NO: 18842 - RNA, 37 nt, Artificial Sequence
  Description of Artificial Sequence:  Enzymatic Nucleic Acid
cacccacagccgaaaggcgagugaggucuccacacac

SEQ ID NO: 18843 - RNA, 37 nt, Artificial Sequence
  Description of Artificial Sequence:  Enzymatic Nucleic Acid
uacacccagccgaaaggcgagugaggucuacccacac

SEQ ID NO: 18844 - RNA, 37 nt, Artificial Sequence
  Description of Artificial Sequence:  Enzymatic Nucleic Acid
cacauacagccgaaaggcgagugaggucuccacaccc

SEQ ID NO: 18845 - RNA, 37 nt, Artificial Sequence
  Description of Artificial Sequence:  Enzymatic Nucleic Acid
cacacauagccgaaaggcgagugaggucuacccacac

SEQ ID NO: 18846 - RNA, 37 nt, Artificial Sequence
  Description of Artificial Sequence:  Enzymatic Nucleic Acid
aaaacacagccgaaaggcgagugaggucuauacaccc

SEQ ID NO: 18847 - RNA, 37 nt, Artificial Sequence
  Description of Artificial Sequence:  Enzymatic Nucleic Acid
acaaaacagccgaaaggcgagugaggucuacauacac

SEQ ID NO: 18848 - RNA, 37 nt, Artificial Sequence
  Description of Artificial Sequence:  Enzymatic Nucleic Acid
gcacaaaagccgaaaggcgagugaggucuacacauac

SEQ ID NO: 18849 - RNA, 37 nt, Artificial Sequence
  Description of Artificial Sequence:  Enzymatic Nucleic Acid
guuaugcagccgaaaggcgagugaggucuaaaacaca

SEQ ID NO: 18850 - RNA, 37 nt, Artificial Sequence
  Description of Artificial Sequence:  Enzymatic Nucleic Acid
uaguuauggccgaaaggcgagugaggucuacaaaaca

SEQ ID NO: 18851 - RNA, 37 nt, Artificial Sequence
  Description of Artificial Sequence:  Enzymatic Nucleic Acid
aaaaguaagccgaaaggcgagugaggucuuuuaaaau

SEQ ID NO: 18852 - RNA, 37 nt, Artificial Sequence
  Description of Artificial Sequence:  Enzymatic Nucleic Acid
aucuguaggccgaaaggcgagugaggucuauauauuc

SEQ ID NO: 18853 - RNA, 37 nt, Artificial Sequence
  Description of Artificial Sequence:  Enzymatic Nucleic Acid
ggaccaaagccgaaaggcgagugaggucucaugucug

SEQ ID NO: 18854 - RNA, 37 nt, Artificial Sequence
  Description of Artificial Sequence:  Enzymatic Nucleic Acid
auauaggagccgaaaggcgagugaggucucaaaccau

SEQ ID NO: 18855 - RNA, 37 nt, Artificial Sequence
  Description of Artificial Sequence:  Enzymatic Nucleic Acid
caucaugagccgaaaggcgagugaggucuuagaaaua

SEQ ID NO: 18856 - RNA, 37 nt, Artificial Sequence
  Description of Artificial Sequence:  Enzymatic Nucleic Acid
acaaaauagccgaaaggcgagugaggucuauucauca

SEQ ID NO: 18857 - RNA, 37 nt, Artificial Sequence
  Description of Artificial Sequence:  Enzymatic Nucleic Acid
augguauagccgaaaggcgagugaggucuaaaauaca

SEQ ID NO: 18858 - RNA, 37 nt, Artificial Sequence
  Description of Artificial Sequence:  Enzymatic Nucleic Acid
uacgauuagccgaaaggcgagugaggucuaaauccca

SEQ ID NO: 18859 - RNA, 37 nt, Artificial Sequence
  Description of Artificial Sequence:  Enzymatic Nucleic Acid
aguugguagccgaaaggcgagugaggucugauuacaa

SEQ ID NO: 18860 - RNA, 37 nt, Artificial Sequence
  Description of Artificial Sequence:  Enzymatic Nucleic Acid
agcaguuggccgaaaggcgagugaggucucaaguuua

SEQ ID NO: 18861 - RNA, 37 nt, Artificial Sequence
  Description of Artificial Sequence:  Enzymatic Nucleic Acid
cauaaaaggccgaaaggcgagugaggucuaguugcca

SEQ ID NO: 18862 - RNA, 37 nt, Artificial Sequence
  Description of Artificial Sequence:  Enzymatic Nucleic Acid
agacagaagccgaaaggcgagugaggucuauaaaagc

SEQ ID NO: 18863 - RNA, 37 nt, Artificial Sequence
  Description of Artificial Sequence:  Enzymatic Nucleic Acid
gaaggagagccgaaaggcgagugaggucuagaacaua

SEQ ID NO: 18864 - RNA, 37 nt, Artificial Sequence
  Description of Artificial Sequence:  Enzymatic Nucleic Acid
aaaaagaggccgaaaggcgagugaggucuuuuuucuu

SEQ ID NO: 18865 - RNA, 37 nt, Artificial Sequence
  Description of Artificial Sequence:  Enzymatic Nucleic Acid
gcucuaaagccgaaaggcgagugaggucuaaggauaa

SEQ ID NO: 18866 - RNA, 37 nt, Artificial Sequence
  Description of Artificial Sequence:  Enzymatic Nucleic Acid
uuucucuggccgaaaggcgagugaggucuucuaaaca

SEQ ID NO: 18867 - RNA, 37 nt, Artificial Sequence
  Description of Artificial Sequence:  Enzymatic Nucleic Acid
uuuugagagccgaaaggcgagugaggucucauuucaa

SEQ ID NO: 18868 - RNA, 37 nt, Artificial Sequence
  Description of Artificial Sequence:  Enzymatic Nucleic Acid
auauuuaggccgaaaggcgagugaggucuaauuuuuu

SEQ ID NO: 18869 - RNA, 37 nt, Artificial Sequence
  Description of Artificial Sequence:  Enzymatic Nucleic Acid
uaaacuaagccgaaaggcgagugaggucuauuuaguu

SEQ ID NO: 18870 - RNA, 37 nt, Artificial Sequence
  Description of Artificial Sequence:  Enzymatic Nucleic Acid
cagcuaaagccgaaaggcgagugaggucuuaacauuu

SEQ ID NO: 18871 - RNA, 37 nt, Artificial Sequence
  Description of Artificial Sequence:  Enzymatic Nucleic Acid
acaaucaggccgaaaggcgagugaggucuuaaacuaa

SEQ ID NO: 18872 - RNA, 37 nt, Artificial Sequence
  Description of Artificial Sequence:  Enzymatic Nucleic Acid
accccauagccgaaaggcgagugaggucuaaucagcu

SEQ ID NO: 18873 - RNA, 37 nt, Artificial Sequence
  Description of Artificial Sequence:  Enzymatic Nucleic Acid
uucgaaaagccgaaaggcgagugaggucucccauaca

SEQ ID NO: 18874 - RNA, 37 nt, Artificial Sequence
  Description of Artificial Sequence:  Enzymatic Nucleic Acid
aaaacaaagccgaaaggcgagugaggucuaaaaagug

SEQ ID NO: 18875 - RNA, 37 nt, Artificial Sequence
  Description of Artificial Sequence:  Enzymatic Nucleic Acid
agguaaaagccgaaaggcgagugaggucuaaacaaaa

SEQ ID NO: 18876 - RNA, 37 nt, Artificial Sequence
  Description of Artificial Sequence:  Enzymatic Nucleic Acid
aauuuacagccgaaaggcgagugaggucuaguuguga

SEQ ID NO: 18877 - RNA, 37 nt, Artificial Sequence
  Description of Artificial Sequence:  Enzymatic Nucleic Acid
gcaauuuagccgaaaggcgagugaggucuacaguugu

SEQ ID NO: 18878 - RNA, 37 nt, Artificial Sequence
  Description of Artificial Sequence:  Enzymatic Nucleic Acid
auuauugggccgaaaggcgagugaggucuaauuuaca

SEQ ID NO: 18879 - RNA, 37 nt, Artificial Sequence
  Description of Artificial Sequence:  Enzymatic Nucleic Acid
uucauggagccgaaaggcgagugaggucuaggaauua

SEQ ID NO: 18880 - RNA, 37 nt, Artificial Sequence
  Description of Artificial Sequence:  Enzymatic Nucleic Acid
auaauuuggccgaaaggcgagugaggucuauuuucau

SEQ ID NO: 18881 - RNA, 37 nt, Artificial Sequence
  Description of Artificial Sequence:  Enzymatic Nucleic Acid
uaucuacagccgaaaggcgagugaggucuuggauaau

SEQ ID NO: 18882 - RNA, 37 nt, Artificial Sequence
  Description of Artificial Sequence:  Enzymatic Nucleic Acid
uauaucuagccgaaaggcgagugaggucuacuggaua

SEQ ID NO: 18883 - RNA, 37 nt, Artificial Sequence
  Description of Artificial Sequence:  Enzymatic Nucleic Acid
aaaacuaggccgaaaggcgagugaggucucaauaucc

SEQ ID NO: 18884 - RNA, 37 nt, Artificial Sequence
  Description of Artificial Sequence:  Enzymatic Nucleic Acid
aggcaaaagccgaaaggcgagugaggucuuagccaau

SEQ ID NO: 18885 - RNA, 37 nt, Artificial Sequence
  Description of Artificial Sequence:  Enzymatic Nucleic Acid
aauaaagggccgaaaggcgagugaggucuaaaacuag

SEQ ID NO: 18886 - RNA, 37 nt, Artificial Sequence
  Description of Artificial Sequence:  Enzymatic Nucleic Acid
ugaauuuggccgaaaggcgagugaggucuuuaauaaa

SEQ ID NO: 18887 - RNA, 37 nt, Artificial Sequence
  Description of Artificial Sequence:  Enzymatic Nucleic Acid
cauucagggccgaaaggcgagugaggucuugaaauga

SEQ ID NO: 18888 - RNA, 37 nt, Artificial Sequence
  Description of Artificial Sequence:  Enzymatic Nucleic Acid
uaggcagagccgaaaggcgagugaggucuauucaggc

SEQ ID NO: 18889 - RNA, 37 nt, Artificial Sequence
  Description of Artificial Sequence:  Enzymatic Nucleic Acid
uauauagggccgaaaggcgagugaggucuagacauuc

SEQ ID NO: 18890 - RNA, 37 nt, Artificial Sequence
  Description of Artificial Sequence:  Enzymatic Nucleic Acid
acaaagaggccgaaaggcgagugaggucuagagaaua

SEQ ID NO: 18891 - RNA, 37 nt, Artificial Sequence
  Description of Artificial Sequence:  Enzymatic Nucleic Acid
ggagaauagccgaaaggcgagugaggucuaaagagca

SEQ ID NO: 18892 - RNA, 37 nt, Artificial Sequence
  Description of Artificial Sequence:  Enzymatic Nucleic Acid
uguuuuaagccgaaaggcgagugaggucuggguucaa

SEQ ID NO: 18893 - RNA, 37 nt, Artificial Sequence
  Description of Artificial Sequence:  Enzymatic Nucleic Acid
gagugccagccgaaaggcgagugaggucuaggauguu

SEQ ID NO: 18894 - DNA, 31 bp, Artificial Sequence
  Description of Artificial Sequence:  Enzymatic Nucleic Acid
tcccggggggctagctacaacgacccgggac

SEQ ID NO: 18895 - DNA, 31 bp, Artificial Sequence
  Description of Artificial Sequence:  Enzymatic Nucleic Acid
actgaccgggctagctacaacgatctcccgg

SEQ ID NO: 18896 - DNA, 31 bp, Artificial Sequence
  Description of Artificial Sequence:  Enzymatic Nucleic Acid
cacactgaggctagctacaacgacgctctcc

SEQ ID NO: 18897 - DNA, 31 bp, Artificial Sequence
  Description of Artificial Sequence:  Enzymatic Nucleic Acid
accacacaggctagctacaacgatgaccgct

SEQ ID NO: 18898 - DNA, 31 bp, Artificial Sequence
  Description of Artificial Sequence:  Enzymatic Nucleic Acid
cgaccacaggctagctacaacgaactgaccg

SEQ ID NO: 18899 - DNA, 31 bp, Artificial Sequence
  Description of Artificial Sequence:  Enzymatic Nucleic Acid
agcgaccaggctagctacaacgaacactgac

SEQ ID NO: 18900 - DNA, 31 bp, Artificial Sequence
  Description of Artificial Sequence:  Enzymatic Nucleic Acid
cgcagcgaggctagctacaacgacacacact

SEQ ID NO: 18901 - DNA, 31 bp, Artificial Sequence
  Description of Artificial Sequence:  Enzymatic Nucleic Acid
aaacgcagggctagctacaacgagaccacac

SEQ ID NO: 18902 - DNA, 31 bp, Artificial Sequence
  Description of Artificial Sequence:  Enzymatic Nucleic Acid
aggaaacgggctagctacaacgaagcgacca

SEQ ID NO: 18903 - DNA, 31 bp, Artificial Sequence
  Description of Artificial Sequence:  Enzymatic Nucleic Acid
agaggaaaggctagctacaacgagcagcgac

SEQ ID NO: 18904 - DNA, 31 bp, Artificial Sequence
  Description of Artificial Sequence:  Enzymatic Nucleic Acid
ggcgcaggggctagctacaacgaagaggaaa

SEQ ID NO: 18905 - DNA, 31 bp, Artificial Sequence
  Description of Artificial Sequence:  Enzymatic Nucleic Acid
gcccggcgggctagctacaacgaaggcagag

SEQ ID NO: 18906 - DNA, 31 bp, Artificial Sequence
  Description of Artificial Sequence:  Enzymatic Nucleic Acid
atgcccggggctagctacaacgagcaggcag

SEQ ID NO: 18907 - DNA, 31 bp, Artificial Sequence
  Description of Artificial Sequence:  Enzymatic Nucleic Acid
aagtgatgggctagctacaacgaccggcgca

SEQ ID NO: 18908 - DNA, 31 bp, Artificial Sequence
  Description of Artificial Sequence:  Enzymatic Nucleic Acid
gcaagtgaggctagctacaacgagcccggcg

SEQ ID NO: 18909 - DNA, 31 bp, Artificial Sequence
  Description of Artificial Sequence:  Enzymatic Nucleic Acid
cgcgcaagggctagctacaacgagatgcccg

SEQ ID NO: 18910 - DNA, 31 bp, Artificial Sequence
  Description of Artificial Sequence:  Enzymatic Nucleic Acid
gcggcgcgggctagctacaacgaaagtgatg

SEQ ID NO: 18911 - DNA, 31 bp, Artificial Sequence
  Description of Artificial Sequence:  Enzymatic Nucleic Acid
ctgcggcgggctagctacaacgagcaagtga

SEQ ID NO: 18912 - DNA, 31 bp, Artificial Sequence
  Description of Artificial Sequence:  Enzymatic Nucleic Acid
ttctgcggggctagctacaacgagcgcaagt

SEQ ID NO: 18913 - DNA, 31 bp, Artificial Sequence
  Description of Artificial Sequence:  Enzymatic Nucleic Acid
actttctgggctagctacaacgaggcgcgca

SEQ ID NO: 18914 - DNA, 31 bp, Artificial Sequence
  Description of Artificial Sequence:  Enzymatic Nucleic Acid
cagacggaggctagctacaacgatttctgcg

SEQ ID NO: 18915 - DNA, 31 bp, Artificial Sequence
  Description of Artificial Sequence:  Enzymatic Nucleic Acid
ctgccagaggctagctacaacgaggactttc

SEQ ID NO: 18916 - DNA, 31 bp, Artificial Sequence
  Description of Artificial Sequence:  Enzymatic Nucleic Acid
ccaggctgggctagctacaacgacagacgga

SEQ ID NO: 18917 - DNA, 31 bp, Artificial Sequence
  Description of Artificial Sequence:  Enzymatic Nucleic Acid
tatccaggggctagctacaacgatgccagac

SEQ ID NO: 18918 - DNA, 31 bp, Artificial Sequence
  Description of Artificial Sequence:  Enzymatic Nucleic Acid
agaggataggctagctacaacgaccaggctg

SEQ ID NO: 18919 - DNA, 31 bp, Artificial Sequence
  Description of Artificial Sequence:  Enzymatic Nucleic Acid
ggagaggaggctagctacaacgaatccaggc

SEQ ID NO: 18920 - DNA, 31 bp, Artificial Sequence
  Description of Artificial Sequence:  Enzymatic Nucleic Acid
ggtgccggggctagctacaacgaaggagagg

SEQ ID NO: 18921 - DNA, 31 bp, Artificial Sequence
  Description of Artificial Sequence:  Enzymatic Nucleic Acid
tgcgggtgggctagctacaacgacggtagga

SEQ ID NO: 18922 - DNA, 31 bp, Artificial Sequence
  Description of Artificial Sequence:  Enzymatic Nucleic Acid
tctgcgggggctagctacaacgagccggtag

SEQ ID NO: 18923 - DNA, 31 bp, Artificial Sequence
  Description of Artificial Sequence:  Enzymatic Nucleic Acid
ggcgtctgggctagctacaacgagggtgccg

SEQ ID NO: 18924 - DNA, 31 bp, Artificial Sequence
  Description of Artificial Sequence:  Enzymatic Nucleic Acid
caggggcgggctagctacaacgactgcgggt

SEQ ID NO: 18925 - DNA, 31 bp, Artificial Sequence
  Description of Artificial Sequence:  Enzymatic Nucleic Acid
tgcaggggggctagctacaacgagtctgcgg

SEQ ID NO: 18926 - DNA, 31 bp, Artificial Sequence
  Description of Artificial Sequence:  Enzymatic Nucleic Acid
ggcggctgggctagctacaacgaaggggcgt

SEQ ID NO: 18927 - DNA, 31 bp, Artificial Sequence
  Description of Artificial Sequence:  Enzymatic Nucleic Acid
accggcggggctagctacaacgatgcagggg

SEQ ID NO: 18928 - DNA, 31 bp, Artificial Sequence
  Description of Artificial Sequence:  Enzymatic Nucleic Acid
ccgaccggggctagctacaacgaggctgcag

SEQ ID NO: 18929 - DNA, 31 bp, Artificial Sequence
  Description of Artificial Sequence:  Enzymatic Nucleic Acid
ggcgccgaggctagctacaacgacggcggct

SEQ ID NO: 18930 - DNA, 31 bp, Artificial Sequence
  Description of Artificial Sequence:  Enzymatic Nucleic Acid
cccgggcgggctagctacaacgacgaccggc

SEQ ID NO: 18931 - DNA, 31 bp, Artificial Sequence
  Description of Artificial Sequence:  Enzymatic Nucleic Acid
agcccgggggctagctacaacgagccgaccg

SEQ ID NO: 18932 - DNA, 31 bp, Artificial Sequence
  Description of Artificial Sequence:  Enzymatic Nucleic Acid
ctagggagggctagctacaacgaccgggcgc

SEQ ID NO: 18933 - DNA, 31 bp, Artificial Sequence
  Description of Artificial Sequence:  Enzymatic Nucleic Acid
gcacagggggctagctacaacgatagggagc

SEQ ID NO: 18934 - DNA, 31 bp, Artificial Sequence
  Description of Artificial Sequence:  Enzymatic Nucleic Acid
tgagcgcaggctagctacaacgaagggctag

SEQ ID NO: 18935 - DNA, 31 bp, Artificial Sequence
  Description of Artificial Sequence:  Enzymatic Nucleic Acid
gttgagcgggctagctacaacgaacagggct

SEQ ID NO: 18936 - DNA, 31 bp, Artificial Sequence
  Description of Artificial Sequence:  Enzymatic Nucleic Acid
cagttgagggctagctacaacgagcacaggg

SEQ ID NO: 18937 - DNA, 31 bp, Artificial Sequence
  Description of Artificial Sequence:  Enzymatic Nucleic Acid
caggacagggctagctacaacgatgagcgca

SEQ ID NO: 18938 - DNA, 31 bp, Artificial Sequence
  Description of Artificial Sequence:  Enzymatic Nucleic Acid
gcgcaggaggctagctacaacgaagttgagc

SEQ ID NO: 18939 - DNA, 31 bp, Artificial Sequence
  Description of Artificial Sequence:  Enzymatic Nucleic Acid
ccgcagcgggctagctacaacgaaggacagt

SEQ ID NO: 18940 - DNA, 31 bp, Artificial Sequence
  Description of Artificial Sequence:  Enzymatic Nucleic Acid
ccccgcagggctagctacaacgagcaggaca

SEQ ID NO: 18941 - DNA, 31 bp, Artificial Sequence
  Description of Artificial Sequence:  Enzymatic Nucleic Acid
gcaccccgggctagctacaacgaagcgcagg

SEQ ID NO: 18942 - DNA, 31 bp, Artificial Sequence
  Description of Artificial Sequence:  Enzymatic Nucleic Acid
tcgcggcaggctagctacaacgacccgcagc

SEQ ID NO: 18943 - DNA, 31 bp, Artificial Sequence
  Description of Artificial Sequence:  Enzymatic Nucleic Acid
actcgcggggctagctacaacgaaccccgca

SEQ ID NO: 18944 - DNA, 31 bp, Artificial Sequence
  Description of Artificial Sequence:  Enzymatic Nucleic Acid
ggaactcgggctagctacaacgaggcacccc

SEQ ID NO: 18945 - DNA, 31 bp, Artificial Sequence
  Description of Artificial Sequence:  Enzymatic Nucleic Acid
aggtggaaggctagctacaacgatcgcggca

SEQ ID NO: 18946 - DNA, 31 bp, Artificial Sequence
  Description of Artificial Sequence:  Enzymatic Nucleic Acid
cgcggaggggctagctacaacgaggaactcg

SEQ ID NO: 18947 - DNA, 31 bp, Artificial Sequence
  Description of Artificial Sequence:  Enzymatic Nucleic Acid
aggaggcgggctagctacaacgaggaggtgg

SEQ ID NO: 18948 - DNA, 31 bp, Artificial Sequence
  Description of Artificial Sequence:  Enzymatic Nucleic Acid
gaaggaggggctagctacaacgagcggaggt

SEQ ID NO: 18949 - DNA, 31 bp, Artificial Sequence
  Description of Artificial Sequence:  Enzymatic Nucleic Acid
agcgcctgggctagctacaacgactagagaa

SEQ ID NO: 18950 - DNA, 31 bp, Artificial Sequence
  Description of Artificial Sequence:  Enzymatic Nucleic Acid
tcccagcgggctagctacaacgactgtctag

SEQ ID NO: 18951 - DNA, 31 bp, Artificial Sequence
  Description of Artificial Sequence:  Enzymatic Nucleic Acid
tctcccagggctagctacaacgagcctgtct

SEQ ID NO: 18952 - DNA, 31 bp, Artificial Sequence
  Description of Artificial Sequence:  Enzymatic Nucleic Acid
ggagccggggctagctacaacgatctttctc

SEQ ID NO: 18953 - DNA, 31 bp, Artificial Sequence
  Description of Artificial Sequence:  Enzymatic Nucleic Acid
ctcgggagggctagctacaacgacggttctt

SEQ ID NO: 18954 - DNA, 31 bp, Artificial Sequence
  Description of Artificial Sequence:  Enzymatic Nucleic Acid
gcccagaaggctagctacaacgatcgggagc

SEQ ID NO: 18955 - DNA, 31 bp, Artificial Sequence
  Description of Artificial Sequence:  Enzymatic Nucleic Acid
gcgaaatgggctagctacaacgaccagaact

SEQ ID NO: 18956 - DNA, 31 bp, Artificial Sequence
  Description of Artificial Sequence:  Enzymatic Nucleic Acid
gggcgaaaggctagctacaacgagcccagaa

SEQ ID NO: 18957 - DNA, 31 bp, Artificial Sequence
  Description of Artificial Sequence:  Enzymatic Nucleic Acid
gagccgggggctagctacaacgagaaatgcc

SEQ ID NO: 18958 - DNA, 31 bp, Artificial Sequence
  Description of Artificial Sequence:  Enzymatic Nucleic Acid
acctcgagggctagctacaacgacgggcgaa

SEQ ID NO: 18959 - DNA, 31 bp, Artificial Sequence
  Description of Artificial Sequence:  Enzymatic Nucleic Acid
atcctgcaggctagctacaacgactcgagcc

SEQ ID NO: 18960 - DNA, 31 bp, Artificial Sequence
  Description of Artificial Sequence:  Enzymatic Nucleic Acid
gcatcctgggctagctacaacgaacctcgag

SEQ ID NO: 18961 - DNA, 31 bp, Artificial Sequence
  Description of Artificial Sequence:  Enzymatic Nucleic Acid
gctctgcaggctagctacaacgacctgcacc

SEQ ID NO: 18962 - DNA, 31 bp, Artificial Sequence
  Description of Artificial Sequence:  Enzymatic Nucleic Acid
ttgctctgggctagctacaacgaatcctgca

SEQ ID NO: 18963 - DNA, 31 bp, Artificial Sequence
  Description of Artificial Sequence:  Enzymatic Nucleic Acid
gcaccttgggctagctacaacgatctgcatc

SEQ ID NO: 18964 - DNA, 31 bp, Artificial Sequence
  Description of Artificial Sequence:  Enzymatic Nucleic Acid
cagcagcaggctagctacaacgacttgctct

SEQ ID NO: 18965 - DNA, 31 bp, Artificial Sequence
  Description of Artificial Sequence:  Enzymatic Nucleic Acid
gccagcagggctagctacaacgaaccttgct

SEQ ID NO: 18966 - DNA, 31 bp, Artificial Sequence
  Description of Artificial Sequence:  Enzymatic Nucleic Acid
acggccagggctagctacaacgaagcacctt

SEQ ID NO: 18967 - DNA, 31 bp, Artificial Sequence
  Description of Artificial Sequence:  Enzymatic Nucleic Acid
ggcgacggggctagctacaacgacagcagca

SEQ ID NO: 18968 - DNA, 31 bp, Artificial Sequence
  Description of Artificial Sequence:  Enzymatic Nucleic Acid
cagggcgaggctagctacaacgaggccagca

SEQ ID NO: 18969 - DNA, 31 bp, Artificial Sequence
  Description of Artificial Sequence:  Enzymatic Nucleic Acid
ccacagggggctagctacaacgagacggcca

SEQ ID NO: 18970 - DNA, 31 bp, Artificial Sequence
  Description of Artificial Sequence:  Enzymatic Nucleic Acid
cagagccaggctagctacaacgaagggcgac

SEQ ID NO: 18971 - DNA, 31 bp, Artificial Sequence
  Description of Artificial Sequence:  Enzymatic Nucleic Acid
acgcagagggctagctacaacgacacagggc

SEQ ID NO: 18972 - DNA, 31 bp, Artificial Sequence
  Description of Artificial Sequence:  Enzymatic Nucleic Acid
tctccacgggctagctacaacgaagagccac

SEQ ID NO: 18973 - DNA, 31 bp, Artificial Sequence
  Description of Artificial Sequence:  Enzymatic Nucleic Acid
ggtctccaggctagctacaacgagcagagcc

SEQ ID NO: 18974 - DNA, 31 bp, Artificial Sequence
  Description of Artificial Sequence:  Enzymatic Nucleic Acid
ggcccgggggctagctacaacgactccacgc

SEQ ID NO: 18975 - DNA, 31 bp, Artificial Sequence
  Description of Artificial Sequence:  Enzymatic Nucleic Acid
agaggcggggctagctacaacgaccgggtct

SEQ ID NO: 18976 - DNA, 31 bp, Artificial Sequence
  Description of Artificial Sequence:  Enzymatic Nucleic Acid
cacagaggggctagctacaacgaggcccggg

SEQ ID NO: 18977 - DNA, 31 bp, Artificial Sequence
  Description of Artificial Sequence:  Enzymatic Nucleic Acid
caaacccaggctagctacaacgaagaggcgg

SEQ ID NO: 18978 - DNA, 31 bp, Artificial Sequence
  Description of Artificial Sequence:  Enzymatic Nucleic Acid
taggcaaaggctagctacaacgaccacagag

SEQ ID NO: 18979 - DNA, 31 bp, Artificial Sequence
  Description of Artificial Sequence:  Enzymatic Nucleic Acid
acactaggggctagctacaacgaaaacccac

SEQ ID NO: 18980 - DNA, 31 bp, Artificial Sequence
  Description of Artificial Sequence:  Enzymatic Nucleic Acid
gagaaacaggctagctacaacgataggcaaa

SEQ ID NO: 18981 - DNA, 31 bp, Artificial Sequence
  Description of Artificial Sequence:  Enzymatic Nucleic Acid
aagagaaaggctagctacaacgaactaggca

SEQ ID NO: 18982 - DNA, 31 bp, Artificial Sequence
  Description of Artificial Sequence:  Enzymatic Nucleic Acid
tgggcagaggctagctacaacgacaagagaa

SEQ ID NO: 18983 - DNA, 31 bp, Artificial Sequence
  Description of Artificial Sequence:  Enzymatic Nucleic Acid
agcctgggggctagctacaacgaagatcaag

SEQ ID NO: 18984 - DNA, 31 bp, Artificial Sequence
  Description of Artificial Sequence:  Enzymatic Nucleic Acid
atgctgagggctagctacaacgactgggcag

SEQ ID NO: 18985 - DNA, 31 bp, Artificial Sequence
  Description of Artificial Sequence:  Enzymatic Nucleic Acid
tttgtatgggctagctacaacgatgagcctg

SEQ ID NO: 18986 - DNA, 31 bp, Artificial Sequence
  Description of Artificial Sequence:  Enzymatic Nucleic Acid
tttttgtaggctagctacaacgagctgagcc

SEQ ID NO: 18987 - DNA, 31 bp, Artificial Sequence
  Description of Artificial Sequence:  Enzymatic Nucleic Acid
tctttttgggctagctacaacgaatgctgag

SEQ ID NO: 18988 - DNA, 31 bp, Artificial Sequence
  Description of Artificial Sequence:  Enzymatic Nucleic Acid
taagtatgggctagctacaacgactttttgt

SEQ ID NO: 18989 - DNA, 31 bp, Artificial Sequence
  Description of Artificial Sequence:  Enzymatic Nucleic Acid
tgtaagtaggctagctacaacgagtcttttt

SEQ ID NO: 18990 - DNA, 31 bp, Artificial Sequence
  Description of Artificial Sequence:  Enzymatic Nucleic Acid
attgtaagggctagctacaacgaatgtcttt

SEQ ID NO: 18991 - DNA, 31 bp, Artificial Sequence
  Description of Artificial Sequence:  Enzymatic Nucleic Acid
cttaattgggctagctacaacgaaagtatgt

SEQ ID NO: 18992 - DNA, 31 bp, Artificial Sequence
  Description of Artificial Sequence:  Enzymatic Nucleic Acid
agccttaaggctagctacaacgatgtaagta

SEQ ID NO: 18993 - DNA, 31 bp, Artificial Sequence
  Description of Artificial Sequence:  Enzymatic Nucleic Acid
tgtattagggctagctacaacgacttaattg

SEQ ID NO: 18994 - DNA, 31 bp, Artificial Sequence
  Description of Artificial Sequence:  Enzymatic Nucleic Acid
gagttgtaggctagctacaacgatagcctta

SEQ ID NO: 18995 - DNA, 31 bp, Artificial Sequence
  Description of Artificial Sequence:  Enzymatic Nucleic Acid
aagagttgggctagctacaacgaattagcct

SEQ ID NO: 18996 - DNA, 31 bp, Artificial Sequence
  Description of Artificial Sequence:  Enzymatic Nucleic Acid
ttgaagagggctagctacaacgatgtattag

SEQ ID NO: 18997 - DNA, 31 bp, Artificial Sequence
  Description of Artificial Sequence:  Enzymatic Nucleic Acid
gcaagtaaggctagctacaacgattgaagag

SEQ ID NO: 18998 - DNA, 31 bp, Artificial Sequence
  Description of Artificial Sequence:  Enzymatic Nucleic Acid
cctgcaagggctagctacaacgaaatttgaa

SEQ ID NO: 18999 - DNA, 31 bp, Artificial Sequence
  Description of Artificial Sequence:  Enzymatic Nucleic Acid
gtcccctgggctagctacaacgaaagtaatt

SEQ ID NO: 19000 - DNA, 31 bp, Artificial Sequence
  Description of Artificial Sequence:  Enzymatic Nucleic Acid
tccctctgggctagctacaacgacccctgca

SEQ ID NO: 19001 - DNA, 31 bp, Artificial Sequence
  Description of Artificial Sequence:  Enzymatic Nucleic Acid
agtccaagggctagctacaacgaccctctgt

SEQ ID NO: 19002 - DNA, 31 bp, Artificial Sequence
  Description of Artificial Sequence:  Enzymatic Nucleic Acid
aaagccagggctagctacaacgaccaagtcc

SEQ ID NO: 19003 - DNA, 31 bp, Artificial Sequence
  Description of Artificial Sequence:  Enzymatic Nucleic Acid
ggccaaagggctagctacaacgacagtccaa

SEQ ID NO: 19004 - DNA, 31 bp, Artificial Sequence
  Description of Artificial Sequence:  Enzymatic Nucleic Acid
ttattgggggctagctacaacgacaaagcca

SEQ ID NO: 19005 - DNA, 31 bp, Artificial Sequence
  Description of Artificial Sequence:  Enzymatic Nucleic Acid
tctgattaggctagctacaacgatgggccaa

SEQ ID NO: 19006 - DNA, 31 bp, Artificial Sequence
  Description of Artificial Sequence:  Enzymatic Nucleic Acid
cactctgaggctagctacaacgatattgggc

SEQ ID NO: 19007 - DNA, 31 bp, Artificial Sequence
  Description of Artificial Sequence:  Enzymatic Nucleic Acid
cactgccaggctagctacaacgatctgatta

SEQ ID NO: 19008 - DNA, 31 bp, Artificial Sequence
  Description of Artificial Sequence:  Enzymatic Nucleic Acid
gctcactgggctagctacaacgacactctga

SEQ ID NO: 19009 - DNA, 31 bp, Artificial Sequence
  Description of Artificial Sequence:  Enzymatic Nucleic Acid
tttgctcaggctagctacaacgatgccactc

SEQ ID NO: 19010 - DNA, 31 bp, Artificial Sequence
  Description of Artificial Sequence:  Enzymatic Nucleic Acid
accctttgggctagctacaacgatcactgcc

SEQ ID NO: 19011 - DNA, 31 bp, Artificial Sequence
  Description of Artificial Sequence:  Enzymatic Nucleic Acid
cacctccaggctagctacaacgacctttgct

SEQ ID NO: 19012 - DNA, 31 bp, Artificial Sequence
  Description of Artificial Sequence:  Enzymatic Nucleic Acid
ctcagtcaggctagctacaacgactccaccc

SEQ ID NO: 19013 - DNA, 31 bp, Artificial Sequence
  Description of Artificial Sequence:  Enzymatic Nucleic Acid
gcactcagggctagctacaacgacacctcca

SEQ ID NO: 19014 - DNA, 31 bp, Artificial Sequence
  Description of Artificial Sequence:  Enzymatic Nucleic Acid
tcgctgcaggctagctacaacgatcagtcac

SEQ ID NO: 19015 - DNA, 31 bp, Artificial Sequence
  Description of Artificial Sequence:  Enzymatic Nucleic Acid
catcgctgggctagctacaacgaactcagtc

SEQ ID NO: 19016 - DNA, 31 bp, Artificial Sequence
  Description of Artificial Sequence:  Enzymatic Nucleic Acid
ggccatcgggctagctacaacgatgcactca

SEQ ID NO: 19017 - DNA, 31 bp, Artificial Sequence
  Description of Artificial Sequence:  Enzymatic Nucleic Acid
agaggccaggctagctacaacgacgctgcac

SEQ ID NO: 19018 - DNA, 31 bp, Artificial Sequence
  Description of Artificial Sequence:  Enzymatic Nucleic Acid
agaagaggggctagctacaacgacatcgctg

SEQ ID NO: 19019 - DNA, 31 bp, Artificial Sequence
  Description of Artificial Sequence:  Enzymatic Nucleic Acid
gtgtcttaggctagctacaacgaagaagagg

SEQ ID NO: 19020 - DNA, 31 bp, Artificial Sequence
  Description of Artificial Sequence:  Enzymatic Nucleic Acid
tgtgagtgggctagctacaacgacttacaga

SEQ ID NO: 19021 - DNA, 31 bp, Artificial Sequence
  Description of Artificial Sequence:  Enzymatic Nucleic Acid
attgtgagggctagctacaacgagtcttaca

SEQ ID NO: 19022 - DNA, 31 bp, Artificial Sequence
  Description of Artificial Sequence:  Enzymatic Nucleic Acid
tggaattgggctagctacaacgagagtgtct

SEQ ID NO: 19023 - DNA, 31 bp, Artificial Sequence
  Description of Artificial Sequence:  Enzymatic Nucleic Acid
ttttggaaggctagctacaacgatgtgagtg

SEQ ID NO: 19024 - DNA, 31 bp, Artificial Sequence
  Description of Artificial Sequence:  Enzymatic Nucleic Acid
tccgatcaggctagctacaacgattttggaa

SEQ ID NO: 19025 - DNA, 31 bp, Artificial Sequence
  Description of Artificial Sequence:  Enzymatic Nucleic Acid
atttccgaggctagctacaacgacacttttg

SEQ ID NO: 19026 - DNA, 31 bp, Artificial Sequence
  Description of Artificial Sequence:  Enzymatic Nucleic Acid
cagtgtcaggctagctacaacgattccgatc

SEQ ID NO: 19027 - DNA, 31 bp, Artificial Sequence
  Description of Artificial Sequence:  Enzymatic Nucleic Acid
ctccagtgggctagctacaacgacatttccg

SEQ ID NO: 19028 - DNA, 31 bp, Artificial Sequence
  Description of Artificial Sequence:  Enzymatic Nucleic Acid
ggctccagggctagctacaacgagtcatttc

SEQ ID NO: 19029 - DNA, 31 bp, Artificial Sequence
  Description of Artificial Sequence:  Enzymatic Nucleic Acid
cttgtaggggctagctacaacgatccagtgt

SEQ ID NO: 19030 - DNA, 31 bp, Artificial Sequence
  Description of Artificial Sequence:  Enzymatic Nucleic Acid
agcacttgggctagctacaacgaaggctcca

SEQ ID NO: 19031 - DNA, 31 bp, Artificial Sequence
  Description of Artificial Sequence:  Enzymatic Nucleic Acid
tagaagcaggctagctacaacgattgtaggc

SEQ ID NO: 19032 - DNA, 31 bp, Artificial Sequence
  Description of Artificial Sequence:  Enzymatic Nucleic Acid
ggtagaagggctagctacaacgaacttgtag

SEQ ID NO: 19033 - DNA, 31 bp, Artificial Sequence
  Description of Artificial Sequence:  Enzymatic Nucleic Acid
tttcccggggctagctacaacgaagaagcac

SEQ ID NO: 19034 - DNA, 31 bp, Artificial Sequence
  Description of Artificial Sequence:  Enzymatic Nucleic Acid
caagtcagggctagctacaacgattcccggt

SEQ ID NO: 19035 - DNA, 31 bp, Artificial Sequence
  Description of Artificial Sequence:  Enzymatic Nucleic Acid
aggccaagggctagctacaacgacagtttcc

SEQ ID NO: 19036 - DNA, 31 bp, Artificial Sequence
  Description of Artificial Sequence:  Enzymatic Nucleic Acid
gaccgaggggctagctacaacgacaagtcag

SEQ ID NO: 19037 - DNA, 31 bp, Artificial Sequence
  Description of Artificial Sequence:  Enzymatic Nucleic Acid
ataaatgaggctagctacaacgacgaggcca

SEQ ID NO: 19038 - DNA, 31 bp, Artificial Sequence
  Description of Artificial Sequence:  Enzymatic Nucleic Acid
gacataaaggctagctacaacgagaccgagg

SEQ ID NO: 19039 - DNA, 31 bp, Artificial Sequence
  Description of Artificial Sequence:  Enzymatic Nucleic Acid
catagacaggctagctacaacgaaaatgacc

SEQ ID NO: 19040 - DNA, 31 bp, Artificial Sequence
  Description of Artificial Sequence:  Enzymatic Nucleic Acid
aacatagaggctagctacaacgaataaatga

SEQ ID NO: 19041 - DNA, 31 bp, Artificial Sequence
  Description of Artificial Sequence:  Enzymatic Nucleic Acid
cttgaacaggctagctacaacgaagacataa

SEQ ID NO: 19042 - DNA, 31 bp, Artificial Sequence
  Description of Artificial Sequence:  Enzymatic Nucleic Acid
atcttgaaggctagctacaacgaatagacat

SEQ ID NO: 19043 - DNA, 31 bp, Artificial Sequence
  Description of Artificial Sequence:  Enzymatic Nucleic Acid
atctgtaaggctagctacaacgacttgaaca

SEQ ID NO: 19044 - DNA, 31 bp, Artificial Sequence
  Description of Artificial Sequence:  Enzymatic Nucleic Acid
gagatctgggctagctacaacgaaatcttga

SEQ ID NO: 19045 - DNA, 31 bp, Artificial Sequence
  Description of Artificial Sequence:  Enzymatic Nucleic Acid
aatggagaggctagctacaacgactgtaatc

SEQ ID NO: 19046 - DNA, 31 bp, Artificial Sequence
  Description of Artificial Sequence:  Enzymatic Nucleic Acid
gcaataaaggctagctacaacgaggagatct

SEQ ID NO: 19047 - DNA, 31 bp, Artificial Sequence
  Description of Artificial Sequence:  Enzymatic Nucleic Acid
agaagcaaggctagctacaacgaaaatggag

SEQ ID NO: 19048 - DNA, 31 bp, Artificial Sequence
  Description of Artificial Sequence:  Enzymatic Nucleic Acid
aacagaagggctagctacaacgaaataaatg

SEQ ID NO: 19049 - DNA, 31 bp, Artificial Sequence
  Description of Artificial Sequence:  Enzymatic Nucleic Acid
gtcactaaggctagctacaacgaagaagcaa

SEQ ID NO: 19050 - DNA, 31 bp, Artificial Sequence
  Description of Artificial Sequence:  Enzymatic Nucleic Acid
gttggtcaggctagctacaacgataacagaa

SEQ ID NO: 19051 - DNA, 31 bp, Artificial Sequence
  Description of Artificial Sequence:  Enzymatic Nucleic Acid
catgttggggctagctacaacgacactaaca

SEQ ID NO: 19052 - DNA, 31 bp, Artificial Sequence
  Description of Artificial Sequence:  Enzymatic Nucleic Acid
actccatgggctagctacaacgatggtcact

SEQ ID NO: 19053 - DNA, 31 bp, Artificial Sequence
  Description of Artificial Sequence:  Enzymatic Nucleic Acid
cgactccaggctagctacaacgagttggtca

SEQ ID NO: 19054 - DNA, 31 bp, Artificial Sequence
  Description of Artificial Sequence:  Enzymatic Nucleic Acid
gtacacgaggctagctacaacgatccatgtt

SEQ ID NO: 19055 - DNA, 31 bp, Artificial Sequence
  Description of Artificial Sequence:  Enzymatic Nucleic Acid
aatgtacaggctagctacaacgagactccat

SEQ ID NO: 19056 - DNA, 31 bp, Artificial Sequence
  Description of Artificial Sequence:  Enzymatic Nucleic Acid
gtaatgtaggctagctacaacgaacgactcc

SEQ ID NO: 19057 - DNA, 31 bp, Artificial Sequence
  Description of Artificial Sequence:  Enzymatic Nucleic Acid
cagtaatgggctagctacaacgaacacgact

SEQ ID NO: 19058 - DNA, 31 bp, Artificial Sequence
  Description of Artificial Sequence:  Enzymatic Nucleic Acid
ctcagtaaggctagctacaacgagtacacga

SEQ ID NO: 19059 - DNA, 31 bp, Artificial Sequence
  Description of Artificial Sequence:  Enzymatic Nucleic Acid
gttctcagggctagctacaacgaaatgtaca

SEQ ID NO: 19060 - DNA, 31 bp, Artificial Sequence
  Description of Artificial Sequence:  Enzymatic Nucleic Acid
tgtttttgggctagctacaacgatctcagta

SEQ ID NO: 19061 - DNA, 31 bp, Artificial Sequence
  Description of Artificial Sequence:  Enzymatic Nucleic Acid
cagttttgggctagctacaacgattttgttc

SEQ ID NO: 19062 - DNA, 31 bp, Artificial Sequence
  Description of Artificial Sequence:  Enzymatic Nucleic Acid
caccacagggctagctacaacgatttgtttt

SEQ ID NO: 19063 - DNA, 31 bp, Artificial Sequence
  Description of Artificial Sequence:  Enzymatic Nucleic Acid
aatcaccaggctagctacaacgaagttttgt

SEQ ID NO: 19064 - DNA, 31 bp, Artificial Sequence
  Description of Artificial Sequence:  Enzymatic Nucleic Acid
tggaatcaggctagctacaacgacacagttt

SEQ ID NO: 19065 - DNA, 31 bp, Artificial Sequence
  Description of Artificial Sequence:  Enzymatic Nucleic Acid
acatggaaggctagctacaacgacaccacag

SEQ ID NO: 19066 - DNA, 31 bp, Artificial Sequence
  Description of Artificial Sequence:  Enzymatic Nucleic Acid
ccgagacaggctagctacaacgaggaatcac

SEQ ID NO: 19067 - DNA, 31 bp, Artificial Sequence
  Description of Artificial Sequence:  Enzymatic Nucleic Acid
acccgagaggctagctacaacgaatggaatc

SEQ ID NO: 19068 - DNA, 31 bp, Artificial Sequence
  Description of Artificial Sequence:  Enzymatic Nucleic Acid
gaaatggaggctagctacaacgaccgagaca

SEQ ID NO: 19069 - DNA, 31 bp, Artificial Sequence
  Description of Artificial Sequence:  Enzymatic Nucleic Acid
atttgaaaggctagctacaacgaggacccga

SEQ ID NO: 19070 - DNA, 31 bp, Artificial Sequence
  Description of Artificial Sequence:  Enzymatic Nucleic Acid
cgttgagaggctagctacaacgattgaaatg

SEQ ID NO: 19071 - DNA, 31 bp, Artificial Sequence
  Description of Artificial Sequence:  Enzymatic Nucleic Acid
gtgacacgggctagctacaacgatgagattt

SEQ ID NO: 19072 - DNA, 31 bp, Artificial Sequence
  Description of Artificial Sequence:  Enzymatic Nucleic Acid
aagtgacaggctagctacaacgagttgagat

SEQ ID NO: 19073 - DNA, 31 bp, Artificial Sequence
  Description of Artificial Sequence:  Enzymatic Nucleic Acid
caaagtgaggctagctacaacgaacgttgag

SEQ ID NO: 19074 - DNA, 31 bp, Artificial Sequence
  Description of Artificial Sequence:  Enzymatic Nucleic Acid
gcacaaagggctagctacaacgagacacgtt

SEQ ID NO: 19075 - DNA, 31 bp, Artificial Sequence
  Description of Artificial Sequence:  Enzymatic Nucleic Acid
atcttgcaggctagctacaacgaaaagtgac

SEQ ID NO: 19076 - DNA, 31 bp, Artificial Sequence
  Description of Artificial Sequence:  Enzymatic Nucleic Acid
gtatcttgggctagctacaacgaacaaagtg

SEQ ID NO: 19077 - DNA, 31 bp, Artificial Sequence
  Description of Artificial Sequence:  Enzymatic Nucleic Acid
tctgggtaggctagctacaacgacttgcaca

SEQ ID NO: 19078 - DNA, 31 bp, Artificial Sequence
  Description of Artificial Sequence:  Enzymatic Nucleic Acid
tttctgggggctagctacaacgaatcttgca

SEQ ID NO: 19079 - DNA, 31 bp, Artificial Sequence
  Description of Artificial Sequence:  Enzymatic Nucleic Acid
ggaacaaaggctagctacaacgactcttttc

SEQ ID NO: 19080 - DNA, 31 bp, Artificial Sequence
  Description of Artificial Sequence:  Enzymatic Nucleic Acid
atcaggaaggctagctacaacgaaaatctct

SEQ ID NO: 19081 - DNA, 31 bp, Artificial Sequence
  Description of Artificial Sequence:  Enzymatic Nucleic Acid
tgttaccaggctagctacaacgacaggaaca

SEQ ID NO: 19082 - DNA, 31 bp, Artificial Sequence
  Description of Artificial Sequence:  Enzymatic Nucleic Acid
ttctgttaggctagctacaacgacatcagga

SEQ ID NO: 19083 - DNA, 31 bp, Artificial Sequence
  Description of Artificial Sequence:  Enzymatic Nucleic Acid
aaattctgggctagctacaacgataccatca

SEQ ID NO: 19084 - DNA, 31 bp, Artificial Sequence
  Description of Artificial Sequence:  Enzymatic Nucleic Acid
ccaggaaaggctagctacaacgatctgttac

SEQ ID NO: 19085 - DNA, 31 bp, Artificial Sequence
  Description of Artificial Sequence:  Enzymatic Nucleic Acid
tcttgctgggctagctacaacgacccaggaa

SEQ ID NO: 19086 - DNA, 31 bp, Artificial Sequence
  Description of Artificial Sequence:  Enzymatic Nucleic Acid
ccttcttgggctagctacaacgatgtcccag

SEQ ID NO: 19087 - DNA, 31 bp, Artificial Sequence
  Description of Artificial Sequence:  Enzymatic Nucleic Acid
tagtaaagggctagctacaacgaccttcttg

SEQ ID NO: 19088 - DNA, 31 bp, Artificial Sequence
  Description of Artificial Sequence:  Enzymatic Nucleic Acid
gggaatagggctagctacaacgaaaagccct

SEQ ID NO: 19089 - DNA, 31 bp, Artificial Sequence
  Description of Artificial Sequence:  Enzymatic Nucleic Acid
gctgggaaggctagctacaacgaagtaaagc

SEQ ID NO: 19090 - DNA, 31 bp, Artificial Sequence
  Description of Artificial Sequence:  Enzymatic Nucleic Acid
tcatgtagggctagctacaacgatgggaata

SEQ ID NO: 19091 - DNA, 31 bp, Artificial Sequence
  Description of Artificial Sequence:  Enzymatic Nucleic Acid
tgatcatgggctagctacaacgaagctggga

SEQ ID NO: 19092 - DNA, 31 bp, Artificial Sequence
  Description of Artificial Sequence:  Enzymatic Nucleic Acid
gctgatcaggctagctacaacgagtagctgg

SEQ ID NO: 19093 - DNA, 31 bp, Artificial Sequence
  Description of Artificial Sequence:  Enzymatic Nucleic Acid
atagctgaggctagctacaacgacatgtagc

SEQ ID NO: 19094 - DNA, 31 bp, Artificial Sequence
  Description of Artificial Sequence:  Enzymatic Nucleic Acid
cagcatagggctagctacaacgatgatcatg

SEQ ID NO: 19095 - DNA, 31 bp, Artificial Sequence
  Description of Artificial Sequence:  Enzymatic Nucleic Acid
tgccagcaggctagctacaacgaagctgatc

SEQ ID NO: 19096 - DNA, 31 bp, Artificial Sequence
  Description of Artificial Sequence:  Enzymatic Nucleic Acid
catgccagggctagctacaacgaatagctga

SEQ ID NO: 19097 - DNA, 31 bp, Artificial Sequence
  Description of Artificial Sequence:  Enzymatic Nucleic Acid
agaccatgggctagctacaacgacagcatag

SEQ ID NO: 19098 - DNA, 31 bp, Artificial Sequence
  Description of Artificial Sequence:  Enzymatic Nucleic Acid
gaagaccaggctagctacaacgagccagcat

SEQ ID NO: 19099 - DNA, 31 bp, Artificial Sequence
  Description of Artificial Sequence:  Enzymatic Nucleic Acid
acagaagaggctagctacaacgacatgccag

SEQ ID NO: 19100 - DNA, 31 bp, Artificial Sequence
  Description of Artificial Sequence:  Enzymatic Nucleic Acid
ttgcttcaggctagctacaacgaagaagacc

SEQ ID NO: 19101 - DNA, 31 bp, Artificial Sequence
  Description of Artificial Sequence:  Enzymatic Nucleic Acid
aatttttgggctagctacaacgattcacaga

SEQ ID NO: 19102 - DNA, 31 bp, Artificial Sequence
  Description of Artificial Sequence:  Enzymatic Nucleic Acid
atcattaaggctagctacaacgattttgctt

SEQ ID NO: 19103 - DNA, 31 bp, Artificial Sequence
  Description of Artificial Sequence:  Enzymatic Nucleic Acid
tttcatcaggctagctacaacgataattttt

SEQ ID NO: 19104 - DNA, 31 bp, Artificial Sequence
  Description of Artificial Sequence:  Enzymatic Nucleic Acid
aactttcaggctagctacaacgacattaatt

SEQ ID NO: 19105 - DNA, 31 bp, Artificial Sequence
  Description of Artificial Sequence:  Enzymatic Nucleic Acid
actggtaaggctagctacaacgatttcatca

SEQ ID NO: 19106 - DNA, 31 bp, Artificial Sequence
  Description of Artificial Sequence:  Enzymatic Nucleic Acid
tagactggggctagctacaacgaaactttca

SEQ ID NO: 19107 - DNA, 31 bp, Artificial Sequence
  Description of Artificial Sequence:  Enzymatic Nucleic Acid
ataatagaggctagctacaacgatggtaact

SEQ ID NO: 19108 - DNA, 31 bp, Artificial Sequence
  Description of Artificial Sequence:  Enzymatic Nucleic Acid
gtacataaggctagctacaacgaagactggt

SEQ ID NO: 19109 - DNA, 31 bp, Artificial Sequence
  Description of Artificial Sequence:  Enzymatic Nucleic Acid
tatgtacaggctagctacaacgaaatagact

SEQ ID NO: 19110 - DNA, 31 bp, Artificial Sequence
  Description of Artificial Sequence:  Enzymatic Nucleic Acid
actatgtaggctagctacaacgaataataga

SEQ ID NO: 19111 - DNA, 31 bp, Artificial Sequence
  Description of Artificial Sequence:  Enzymatic Nucleic Acid
caactatgggctagctacaacgaacataata

SEQ ID NO: 19112 - DNA, 31 bp, Artificial Sequence
  Description of Artificial Sequence:  Enzymatic Nucleic Acid
gacaactaggctagctacaacgagtacataa

SEQ ID NO: 19113 - DNA, 31 bp, Artificial Sequence
  Description of Artificial Sequence:  Enzymatic Nucleic Acid
aacgacaaggctagctacaacgatatgtaca

SEQ ID NO: 19114 - DNA, 31 bp, Artificial Sequence
  Description of Artificial Sequence:  Enzymatic Nucleic Acid
tacaacgaggctagctacaacgaaactatgt

SEQ ID NO: 19115 - DNA, 31 bp, Artificial Sequence
  Description of Artificial Sequence:  Enzymatic Nucleic Acid
ccctacaaggctagctacaacgagacaacta

SEQ ID NO: 19116 - DNA, 31 bp, Artificial Sequence
  Description of Artificial Sequence:  Enzymatic Nucleic Acid
ataccctaggctagctacaacgaaacgacaa

SEQ ID NO: 19117 - DNA, 31 bp, Artificial Sequence
  Description of Artificial Sequence:  Enzymatic Nucleic Acid
atcctataggctagctacaacgacctacaac

SEQ ID NO: 19118 - DNA, 31 bp, Artificial Sequence
  Description of Artificial Sequence:  Enzymatic Nucleic Acid
aaatcctaggctagctacaacgaaccctaca

SEQ ID NO: 19119 - DNA, 31 bp, Artificial Sequence
  Description of Artificial Sequence:  Enzymatic Nucleic Acid
atcataaaggctagctacaacgacctatacc

SEQ ID NO: 19120 - DNA, 31 bp, Artificial Sequence
  Description of Artificial Sequence:  Enzymatic Nucleic Acid
ccacatcaggctagctacaacgaaaatccta

SEQ ID NO: 19121 - DNA, 31 bp, Artificial Sequence
  Description of Artificial Sequence:  Enzymatic Nucleic Acid
gaaccacaggctagctacaacgacataaatc

SEQ ID NO: 19122 - DNA, 31 bp, Artificial Sequence
  Description of Artificial Sequence:  Enzymatic Nucleic Acid
cagaaccaggctagctacaacgaatcataaa

SEQ ID NO: 19123 - DNA, 31 bp, Artificial Sequence
  Description of Artificial Sequence:  Enzymatic Nucleic Acid
actcagaaggctagctacaacgacacatcat

SEQ ID NO: 19124 - DNA, 31 bp, Artificial Sequence
  Description of Artificial Sequence:  Enzymatic Nucleic Acid
gagacggaggctagctacaacgatcagaacc

SEQ ID NO: 19125 - DNA, 31 bp, Artificial Sequence
  Description of Artificial Sequence:  Enzymatic Nucleic Acid
ccatgagaggctagctacaacgaggactcag

SEQ ID NO: 19126 - DNA, 31 bp, Artificial Sequence
  Description of Artificial Sequence:  Enzymatic Nucleic Acid
caattccaggctagctacaacgagagacgga

SEQ ID NO: 19127 - DNA, 31 bp, Artificial Sequence
  Description of Artificial Sequence:  Enzymatic Nucleic Acid
tagttcaaggctagctacaacgatccatgag

SEQ ID NO: 19128 - DNA, 31 bp, Artificial Sequence
  Description of Artificial Sequence:  Enzymatic Nucleic Acid
acagatagggctagctacaacgatcaattcc

SEQ ID NO: 19129 - DNA, 31 bp, Artificial Sequence
  Description of Artificial Sequence:  Enzymatic Nucleic Acid
ccaacagaggctagctacaacgaagttcaat

SEQ ID NO: 19130 - DNA, 31 bp, Artificial Sequence
  Description of Artificial Sequence:  Enzymatic Nucleic Acid
ttctccaaggctagctacaacgaagatagtt

SEQ ID NO: 19131 - DNA, 31 bp, Artificial Sequence
  Description of Artificial Sequence:  Enzymatic Nucleic Acid
aagacaagggctagctacaacgattttctcc

SEQ ID NO: 19132 - DNA, 31 bp, Artificial Sequence
  Description of Artificial Sequence:  Enzymatic Nucleic Acid
atttaagaggctagctacaacgaaagctttt

SEQ ID NO: 19133 - DNA, 31 bp, Artificial Sequence
  Description of Artificial Sequence:  Enzymatic Nucleic Acid
ctgtacaaggctagctacaacgattaagaca

SEQ ID NO: 19134 - DNA, 31 bp, Artificial Sequence
  Description of Artificial Sequence:  Enzymatic Nucleic Acid
ttgctgtaggctagctacaacgaaatttaag

SEQ ID NO: 19135 - DNA, 31 bp, Artificial Sequence
  Description of Artificial Sequence:  Enzymatic Nucleic Acid
tcttgctgggctagctacaacgaacaattta

SEQ ID NO: 19136 - DNA, 31 bp, Artificial Sequence
  Description of Artificial Sequence:  Enzymatic Nucleic Acid
agttcttgggctagctacaacgatgtacaat

SEQ ID NO: 19137 - DNA, 31 bp, Artificial Sequence
  Description of Artificial Sequence:  Enzymatic Nucleic Acid
tagttcagggctagctacaacgatcttgctg

SEQ ID NO: 19138 - DNA, 31 bp, Artificial Sequence
  Description of Artificial Sequence:  Enzymatic Nucleic Acid
acatttagggctagctacaacgatcagttct

SEQ ID NO: 19139 - DNA, 31 bp, Artificial Sequence
  Description of Artificial Sequence:  Enzymatic Nucleic Acid
tccccacaggctagctacaacgattagttca

SEQ ID NO: 19140 - DNA, 31 bp, Artificial Sequence
  Description of Artificial Sequence:  Enzymatic Nucleic Acid
aatccccaggctagctacaacgaatttagtt

SEQ ID NO: 19141 - DNA, 31 bp, Artificial Sequence
  Description of Artificial Sequence:  Enzymatic Nucleic Acid
gaagtcaaggctagctacaacgaccccacat

SEQ ID NO: 19142 - DNA, 31 bp, Artificial Sequence
  Description of Artificial Sequence:  Enzymatic Nucleic Acid
agttgaagggctagctacaacgacaatcccc

SEQ ID NO: 19143 - DNA, 31 bp, Artificial Sequence
  Description of Artificial Sequence:  Enzymatic Nucleic Acid
attcccagggctagctacaacgatgaagtca

SEQ ID NO: 19144 - DNA, 31 bp, Artificial Sequence
  Description of Artificial Sequence:  Enzymatic Nucleic Acid
gaagggtaggctagctacaacgatcccagtt

SEQ ID NO: 19145 - DNA, 31 bp, Artificial Sequence
  Description of Artificial Sequence:  Enzymatic Nucleic Acid
aagaagggggctagctacaacgaattcccag

SEQ ID NO: 19146 - DNA, 31 bp, Artificial Sequence
  Description of Artificial Sequence:  Enzymatic Nucleic Acid
tgctgatgggctagctacaacgattcgaaga

SEQ ID NO: 19147 - DNA, 31 bp, Artificial Sequence
  Description of Artificial Sequence:  Enzymatic Nucleic Acid
tatgctgaggctagctacaacgagcttcgaa

SEQ ID NO: 19148 - DNA, 31 bp, Artificial Sequence
  Description of Artificial Sequence:  Enzymatic Nucleic Acid
ttcttatgggctagctacaacgatgatgctt

SEQ ID NO: 19149 - DNA, 31 bp, Artificial Sequence
  Description of Artificial Sequence:  Enzymatic Nucleic Acid
gtttcttaggctagctacaacgagctgatgc

SEQ ID NO: 19150 - DNA, 31 bp, Artificial Sequence
  Description of Artificial Sequence:  Enzymatic Nucleic Acid
tttacaagggctagctacaacgattcttatg

SEQ ID NO: 19151 - DNA, 31 bp, Artificial Sequence
  Description of Artificial Sequence:  Enzymatic Nucleic Acid
tcggtttaggctagctacaacgaaagtttct

SEQ ID NO: 19152 - DNA, 31 bp, Artificial Sequence
  Description of Artificial Sequence:  Enzymatic Nucleic Acid
ggtctcggggctagctacaacgattacaagt

SEQ ID NO: 19153 - DNA, 31 bp, Artificial Sequence
  Description of Artificial Sequence:  Enzymatic Nucleic Acid
tttttaggggctagctacaacgactcggttt

SEQ ID NO: 19154 - DNA, 31 bp, Artificial Sequence
  Description of Artificial Sequence:  Enzymatic Nucleic Acid
agactgggggctagctacaacgattttaggt

SEQ ID NO: 19155 - DNA, 31 bp, Artificial Sequence
  Description of Artificial Sequence:  Enzymatic Nucleic Acid
ctcccagaggctagctacaacgatgggtttt

SEQ ID NO: 19156 - DNA, 31 bp, Artificial Sequence
  Description of Artificial Sequence:  Enzymatic Nucleic Acid
tcatctcaggctagctacaacgatcccagac

SEQ ID NO: 19157 - DNA, 31 bp, Artificial Sequence
  Description of Artificial Sequence:  Enzymatic Nucleic Acid
tttcttcaggctagctacaacgactcactcc

SEQ ID NO: 19158 - DNA, 31 bp, Artificial Sequence
  Description of Artificial Sequence:  Enzymatic Nucleic Acid
ctcaaaaaggctagctacaacgattcttcat

SEQ ID NO: 19159 - DNA, 31 bp, Artificial Sequence
  Description of Artificial Sequence:  Enzymatic Nucleic Acid
ttaaggtgggctagctacaacgatcaaaaat

SEQ ID NO: 19160 - DNA, 31 bp, Artificial Sequence
  Description of Artificial Sequence:  Enzymatic Nucleic Acid
agttaaggggctagctacaacgagctcaaaa

SEQ ID NO: 19161 - DNA, 31 bp, Artificial Sequence
  Description of Artificial Sequence:  Enzymatic Nucleic Acid
atctatagggctagctacaacgataaggtgc

SEQ ID NO: 19162 - DNA, 31 bp, Artificial Sequence
  Description of Artificial Sequence:  Enzymatic Nucleic Acid
accatctaggctagctacaacgaagttaagg

SEQ ID NO: 19163 - DNA, 31 bp, Artificial Sequence
  Description of Artificial Sequence:  Enzymatic Nucleic Acid
ttacaccaggctagctacaacgactatagtt

SEQ ID NO: 19164 - DNA, 31 bp, Artificial Sequence
  Description of Artificial Sequence:  Enzymatic Nucleic Acid
gggttacaggctagctacaacgacatctata

SEQ ID NO: 19165 - DNA, 31 bp, Artificial Sequence
  Description of Artificial Sequence:  Enzymatic Nucleic Acid
ccgggttaggctagctacaacgaaccatcta

SEQ ID NO: 19166 - DNA, 31 bp, Artificial Sequence
  Description of Artificial Sequence:  Enzymatic Nucleic Acid
actccgggggctagctacaacgatacaccat

SEQ ID NO: 19167 - DNA, 31 bp, Artificial Sequence
  Description of Artificial Sequence:  Enzymatic Nucleic Acid
cttggtcaggctagctacaacgatccgggtt

SEQ ID NO: 19168 - DNA, 31 bp, Artificial Sequence
  Description of Artificial Sequence:  Enzymatic Nucleic Acid
atccttggggctagctacaacgacactccgg

SEQ ID NO: 19169 - DNA, 31 bp, Artificial Sequence
  Description of Artificial Sequence:  Enzymatic Nucleic Acid
gtgtacaaggctagctacaacgaccttggtc

SEQ ID NO: 19170 - DNA, 31 bp, Artificial Sequence
  Description of Artificial Sequence:  Enzymatic Nucleic Acid
caggtgtaggctagctacaacgaaatccttg

SEQ ID NO: 19171 - DNA, 31 bp, Artificial Sequence
  Description of Artificial Sequence:  Enzymatic Nucleic Acid
cacaggtgggctagctacaacgaacaatcct

SEQ ID NO: 19172 - DNA, 31 bp, Artificial Sequence
  Description of Artificial Sequence:  Enzymatic Nucleic Acid
tgcacaggggctagctacaacgagtacaatc

SEQ ID NO: 19173 - DNA, 31 bp, Artificial Sequence
  Description of Artificial Sequence:  Enzymatic Nucleic Acid
atgctgcaggctagctacaacgaaggtgtac

SEQ ID NO: 19174 - DNA, 31 bp, Artificial Sequence
  Description of Artificial Sequence:  Enzymatic Nucleic Acid
ggatgctgggctagctacaacgaacaggtgt

SEQ ID NO: 19175 - DNA, 31 bp, Artificial Sequence
  Description of Artificial Sequence:  Enzymatic Nucleic Acid
actggatgggctagctacaacgatgcacagg

SEQ ID NO: 19176 - DNA, 31 bp, Artificial Sequence
  Description of Artificial Sequence:  Enzymatic Nucleic Acid
ccactggaggctagctacaacgagctgcaca

SEQ ID NO: 19177 - DNA, 31 bp, Artificial Sequence
  Description of Artificial Sequence:  Enzymatic Nucleic Acid
tcagcccaggctagctacaacgatggatgct

SEQ ID NO: 19178 - DNA, 31 bp, Artificial Sequence
  Description of Artificial Sequence:  Enzymatic Nucleic Acid
gtcatcagggctagctacaacgaccactgga

SEQ ID NO: 19179 - DNA, 31 bp, Artificial Sequence
  Description of Artificial Sequence:  Enzymatic Nucleic Acid
cttggtcaggctagctacaacgacagcccac

SEQ ID NO: 19180 - DNA, 31 bp, Artificial Sequence
  Description of Artificial Sequence:  Enzymatic Nucleic Acid
cttcttggggctagctacaacgacatcagcc

SEQ ID NO: 19181 - DNA, 31 bp, Artificial Sequence
  Description of Artificial Sequence:  Enzymatic Nucleic Acid
atgtgctgggctagctacaacgatcttcttg

SEQ ID NO: 19182 - DNA, 31 bp, Artificial Sequence
  Description of Artificial Sequence:  Enzymatic Nucleic Acid
caaatgtgggctagctacaacgatgttcttc

SEQ ID NO: 19183 - DNA, 31 bp, Artificial Sequence
  Description of Artificial Sequence:  Enzymatic Nucleic Acid
gacaaatgggctagctacaacgagctgttct

SEQ ID NO: 19184 - DNA, 31 bp, Artificial Sequence
  Description of Artificial Sequence:  Enzymatic Nucleic Acid
ctgacaaaggctagctacaacgagtgctgtt

SEQ ID NO: 19185 - DNA, 31 bp, Artificial Sequence
  Description of Artificial Sequence:  Enzymatic Nucleic Acid
gaccctgaggctagctacaacgaaaatgtgc

SEQ ID NO: 19186 - DNA, 31 bp, Artificial Sequence
  Description of Artificial Sequence:  Enzymatic Nucleic Acid
ttcatggaggctagctacaacgacctgacaa

SEQ ID NO: 19187 - DNA, 31 bp, Artificial Sequence
  Description of Artificial Sequence:  Enzymatic Nucleic Acid
gtttttcaggctagctacaacgaggaccctg

SEQ ID NO: 19188 - DNA, 31 bp, Artificial Sequence
  Description of Artificial Sequence:  Enzymatic Nucleic Acid
acaaaaggggctagctacaacgattttcatg

SEQ ID NO: 19189 - DNA, 31 bp, Artificial Sequence
  Description of Artificial Sequence:  Enzymatic Nucleic Acid
aaaagcaaggctagctacaacgaaaaaggtt

SEQ ID NO: 19190 - DNA, 31 bp, Artificial Sequence
  Description of Artificial Sequence:  Enzymatic Nucleic Acid
tccaaaagggctagctacaacgaaacaaaag

SEQ ID NO: 19191 - DNA, 31 bp, Artificial Sequence
  Description of Artificial Sequence:  Enzymatic Nucleic Acid
ccatgccaggctagctacaacgattccaaaa

SEQ ID NO: 19192 - DNA, 31 bp, Artificial Sequence
  Description of Artificial Sequence:  Enzymatic Nucleic Acid
attccatgggctagctacaacgacacttcca

SEQ ID NO: 19193 - DNA, 31 bp, Artificial Sequence
  Description of Artificial Sequence:  Enzymatic Nucleic Acid
agattccaggctagctacaacgagccacttc

SEQ ID NO: 19194 - DNA, 31 bp, Artificial Sequence
  Description of Artificial Sequence:  Enzymatic Nucleic Acid
accagagaggctagctacaacgatccatgcc

SEQ ID NO: 19195 - DNA, 31 bp, Artificial Sequence
  Description of Artificial Sequence:  Enzymatic Nucleic Acid
ggcttccaggctagctacaacgacagagatt

SEQ ID NO: 19196 - DNA, 31 bp, Artificial Sequence
  Description of Artificial Sequence:  Enzymatic Nucleic Acid
caccgtggggctagctacaacgattccacca

SEQ ID NO: 19197 - DNA, 31 bp, Artificial Sequence
  Description of Artificial Sequence:  Enzymatic Nucleic Acid
ccccaccgggctagctacaacgaggcttcca

SEQ ID NO: 19198 - DNA, 31 bp, Artificial Sequence
  Description of Artificial Sequence:  Enzymatic Nucleic Acid
ctcccccaggctagctacaacgacgtggctt

SEQ ID NO: 19199 - DNA, 31 bp, Artificial Sequence
  Description of Artificial Sequence:  Enzymatic Nucleic Acid
ctgacacgggctagctacaacgatcccccac

SEQ ID NO: 19200 - DNA, 31 bp, Artificial Sequence
  Description of Artificial Sequence:  Enzymatic Nucleic Acid
ttctgacaggctagctacaacgagctccccc

SEQ ID NO: 19201 - DNA, 31 bp, Artificial Sequence
  Description of Artificial Sequence:  Enzymatic Nucleic Acid
gattctgaggctagctacaacgaacgctccc

SEQ ID NO: 19202 - DNA, 31 bp, Artificial Sequence
  Description of Artificial Sequence:  Enzymatic Nucleic Acid
cgcagggaggctagctacaacgatctgacac

SEQ ID NO: 19203 - DNA, 31 bp, Artificial Sequence
  Description of Artificial Sequence:  Enzymatic Nucleic Acid
gtacttcgggctagctacaacgaagggattc

SEQ ID NO: 19204 - DNA, 31 bp, Artificial Sequence
  Description of Artificial Sequence:  Enzymatic Nucleic Acid
ccaaggtaggctagctacaacgattcgcagg

SEQ ID NO: 19205 - DNA, 31 bp, Artificial Sequence
  Description of Artificial Sequence:  Enzymatic Nucleic Acid
aaccaaggggctagctacaacgaacttcgca

SEQ ID NO: 19206 - DNA, 31 bp, Artificial Sequence
  Description of Artificial Sequence:  Enzymatic Nucleic Acid
gtgggtaaggctagctacaacgacaaggtac

SEQ ID NO: 19207 - DNA, 31 bp, Artificial Sequence
  Description of Artificial Sequence:  Enzymatic Nucleic Acid
ggggtgggggctagctacaacgaaaccaagg

SEQ ID NO: 19208 - DNA, 31 bp, Artificial Sequence
  Description of Artificial Sequence:  Enzymatic Nucleic Acid
tctgggggggctagctacaacgagggtaacc

SEQ ID NO: 19209 - DNA, 31 bp, Artificial Sequence
  Description of Artificial Sequence:  Enzymatic Nucleic Acid
ccattttaggctagctacaacgattctgggg

SEQ ID NO: 19210 - DNA, 31 bp, Artificial Sequence
  Description of Artificial Sequence:  Enzymatic Nucleic Acid
ttataccaggctagctacaacgatttatttc

SEQ ID NO: 19211 - DNA, 31 bp, Artificial Sequence
  Description of Artificial Sequence:  Enzymatic Nucleic Acid
tttttataggctagctacaacgacattttat

SEQ ID NO: 19212 - DNA, 31 bp, Artificial Sequence
  Description of Artificial Sequence:  Enzymatic Nucleic Acid
catttttaggctagctacaacgaaccatttt

SEQ ID NO: 19213 - DNA, 31 bp, Artificial Sequence
  Description of Artificial Sequence:  Enzymatic Nucleic Acid
gtattccaggctagctacaacgattttatac

SEQ ID NO: 19214 - DNA, 31 bp, Artificial Sequence
  Description of Artificial Sequence:  Enzymatic Nucleic Acid
aaggggtaggctagctacaacgatccatttt

SEQ ID NO: 19215 - DNA, 31 bp, Artificial Sequence
  Description of Artificial Sequence:  Enzymatic Nucleic Acid
tcaaggggggctagctacaacgaattccatt

SEQ ID NO: 19216 - DNA, 31 bp, Artificial Sequence
  Description of Artificial Sequence:  Enzymatic Nucleic Acid
tgattggaggctagctacaacgatcaagggg

SEQ ID NO: 19217 - DNA, 31 bp, Artificial Sequence
  Description of Artificial Sequence:  Enzymatic Nucleic Acid
ttgtgtgaggctagctacaacgatggactca

SEQ ID NO: 19218 - DNA, 31 bp, Artificial Sequence
  Description of Artificial Sequence:  Enzymatic Nucleic Acid
taattgtgggctagctacaacgagattggac

SEQ ID NO: 19219 - DNA, 31 bp, Artificial Sequence
  Description of Artificial Sequence:  Enzymatic Nucleic Acid
tttaattgggctagctacaacgagtgattgg

SEQ ID NO: 19220 - DNA, 31 bp, Artificial Sequence
  Description of Artificial Sequence:  Enzymatic Nucleic Acid
cgctttaaggctagctacaacgatgtgtgat

SEQ ID NO: 19221 - DNA, 31 bp, Artificial Sequence
  Description of Artificial Sequence:  Enzymatic Nucleic Acid
atgccccgggctagctacaacgatttaattg

SEQ ID NO: 19222 - DNA, 31 bp, Artificial Sequence
  Description of Artificial Sequence:  Enzymatic Nucleic Acid
agtacatgggctagctacaacgacccgcttt

SEQ ID NO: 19223 - DNA, 31 bp, Artificial Sequence
  Description of Artificial Sequence:  Enzymatic Nucleic Acid
tcagtacaggctagctacaacgagccccgct

SEQ ID NO: 19224 - DNA, 31 bp, Artificial Sequence
  Description of Artificial Sequence:  Enzymatic Nucleic Acid
cgtcagtaggctagctacaacgaatgccccg

SEQ ID NO: 19225 - DNA, 31 bp, Artificial Sequence
  Description of Artificial Sequence:  Enzymatic Nucleic Acid
atcgtcagggctagctacaacgaacatgccc

SEQ ID NO: 19226 - DNA, 31 bp, Artificial Sequence
  Description of Artificial Sequence:  Enzymatic Nucleic Acid
cataatcgggctagctacaacgacagtacat

SEQ ID NO: 19227 - DNA, 31 bp, Artificial Sequence
  Description of Artificial Sequence:  Enzymatic Nucleic Acid
ttccataaggctagctacaacgacgtcagta

SEQ ID NO: 19228 - DNA, 31 bp, Artificial Sequence
  Description of Artificial Sequence:  Enzymatic Nucleic Acid
cacttccaggctagctacaacgaaatcgtca

SEQ ID NO: 19229 - DNA, 31 bp, Artificial Sequence
  Description of Artificial Sequence:  Enzymatic Nucleic Acid
ttcactcaggctagctacaacgattccataa

SEQ ID NO: 19230 - DNA, 31 bp, Artificial Sequence
  Description of Artificial Sequence:  Enzymatic Nucleic Acid
ctctttcaggctagctacaacgatcacttcc

SEQ ID NO: 19231 - DNA, 31 bp, Artificial Sequence
  Description of Artificial Sequence:  Enzymatic Nucleic Acid
ttcctgtgggctagctacaacgactctttca

SEQ ID NO: 19232 - DNA, 31 bp, Artificial Sequence
  Description of Artificial Sequence:  Enzymatic Nucleic Acid
atttcctgggctagctacaacgagtctcttt

SEQ ID NO: 19233 - DNA, 31 bp, Artificial Sequence
  Description of Artificial Sequence:  Enzymatic Nucleic Acid
cagtgtaaggctagctacaacgattcctgtg

SEQ ID NO: 19234 - DNA, 31 bp, Artificial Sequence
  Description of Artificial Sequence:  Enzymatic Nucleic Acid
tgacagtgggctagctacaacgaaatttcct

SEQ ID NO: 19235 - DNA, 31 bp, Artificial Sequence
  Description of Artificial Sequence:  Enzymatic Nucleic Acid
gatgacagggctagctacaacgagtaatttc

SEQ ID NO: 19236 - DNA, 31 bp, Artificial Sequence
  Description of Artificial Sequence:  Enzymatic Nucleic Acid
aaggatgaggctagctacaacgaagtgtaat

SEQ ID NO: 19237 - DNA, 31 bp, Artificial Sequence
  Description of Artificial Sequence:  Enzymatic Nucleic Acid
ggtaaggaggctagctacaacgagacagtgt

SEQ ID NO: 19238 - DNA, 31 bp, Artificial Sequence
  Description of Artificial Sequence:  Enzymatic Nucleic Acid
gggattggggctagctacaacgaaaggatga

SEQ ID NO: 19239 - DNA, 31 bp, Artificial Sequence
  Description of Artificial Sequence:  Enzymatic Nucleic Acid
aaatgggaggctagctacaacgatggtaagg

SEQ ID NO: 19240 - DNA, 31 bp, Artificial Sequence
  Description of Artificial Sequence:  Enzymatic Nucleic Acid
ctttgaaaggctagctacaacgagggattgg

SEQ ID NO: 19241 - DNA, 31 bp, Artificial Sequence
  Description of Artificial Sequence:  Enzymatic Nucleic Acid
tggctctgggctagctacaacgattctcctt

SEQ ID NO: 19242 - DNA, 31 bp, Artificial Sequence
  Description of Artificial Sequence:  Enzymatic Nucleic Acid
ccacatggggctagctacaacgatctgcttc

SEQ ID NO: 19243 - DNA, 31 bp, Artificial Sequence
  Description of Artificial Sequence:  Enzymatic Nucleic Acid
agaccacaggctagctacaacgaggctctgc

SEQ ID NO: 19244 - DNA, 31 bp, Artificial Sequence
  Description of Artificial Sequence:  Enzymatic Nucleic Acid
agagaccaggctagctacaacgaatggctct

SEQ ID NO: 19245 - DNA, 31 bp, Artificial Sequence
  Description of Artificial Sequence:  Enzymatic Nucleic Acid
cagagagaggctagctacaacgacacatggc

SEQ ID NO: 19246 - DNA, 31 bp, Artificial Sequence
  Description of Artificial Sequence:  Enzymatic Nucleic Acid
atacacaaggctagctacaacgacagagaga

SEQ ID NO: 19247 - DNA, 31 bp, Artificial Sequence
  Description of Artificial Sequence:  Enzymatic Nucleic Acid
gacatacaggctagctacaacgaaaccagag

SEQ ID NO: 19248 - DNA, 31 bp, Artificial Sequence
  Description of Artificial Sequence:  Enzymatic Nucleic Acid
gggacataggctagctacaacgaacaaccag

SEQ ID NO: 19249 - DNA, 31 bp, Artificial Sequence
  Description of Artificial Sequence:  Enzymatic Nucleic Acid
gtgggacaggctagctacaacgaacacaacc

SEQ ID NO: 19250 - DNA, 31 bp, Artificial Sequence
  Description of Artificial Sequence:  Enzymatic Nucleic Acid
gggtgggaggctagctacaacgaatacacaa

SEQ ID NO: 19251 - DNA, 31 bp, Artificial Sequence
  Description of Artificial Sequence:  Enzymatic Nucleic Acid
atctggggggctagctacaacgagggacata

SEQ ID NO: 19252 - DNA, 31 bp, Artificial Sequence
  Description of Artificial Sequence:  Enzymatic Nucleic Acid
ctcaccaaggctagctacaacgactggggtg

SEQ ID NO: 19253 - DNA, 31 bp, Artificial Sequence
  Description of Artificial Sequence:  Enzymatic Nucleic Acid
atttctcaggctagctacaacgacaatctgg

SEQ ID NO: 19254 - DNA, 31 bp, Artificial Sequence
  Description of Artificial Sequence:  Enzymatic Nucleic Acid
attagagaggctagctacaacgattctcacc

SEQ ID NO: 19255 - DNA, 31 bp, Artificial Sequence
  Description of Artificial Sequence:  Enzymatic Nucleic Acid
aggagagaggctagctacaacgatagagatt

SEQ ID NO: 19256 - DNA, 31 bp, Artificial Sequence
  Description of Artificial Sequence:  Enzymatic Nucleic Acid
ggaatccaggctagctacaacgaaggagaga

SEQ ID NO: 19257 - DNA, 31 bp, Artificial Sequence
  Description of Artificial Sequence:  Enzymatic Nucleic Acid
ggtaggaaggctagctacaacgaccacagga

SEQ ID NO: 19258 - DNA, 31 bp, Artificial Sequence
  Description of Artificial Sequence:  Enzymatic Nucleic Acid
cgtactggggctagctacaacgaaggaatcc

SEQ ID NO: 19259 - DNA, 31 bp, Artificial Sequence
  Description of Artificial Sequence:  Enzymatic Nucleic Acid
gtgccgtaggctagctacaacgatggtagga

SEQ ID NO: 19260 - DNA, 31 bp, Artificial Sequence
  Description of Artificial Sequence:  Enzymatic Nucleic Acid
tggtgccgggctagctacaacgaactggtag

SEQ ID NO: 19261 - DNA, 31 bp, Artificial Sequence
  Description of Artificial Sequence:  Enzymatic Nucleic Acid
gagtggtgggctagctacaacgacgtactgg

SEQ ID NO: 19262 - DNA, 31 bp, Artificial Sequence
  Description of Artificial Sequence:  Enzymatic Nucleic Acid
ttgagtggggctagctacaacgagccgtact

SEQ ID NO: 19263 - DNA, 31 bp, Artificial Sequence
  Description of Artificial Sequence:  Enzymatic Nucleic Acid
cgtttgagggctagctacaacgaggtgccgt

SEQ ID NO: 19264 - DNA, 31 bp, Artificial Sequence
  Description of Artificial Sequence:  Enzymatic Nucleic Acid
tgtcagcgggctagctacaacgattgagtgg

SEQ ID NO: 19265 - DNA, 31 bp, Artificial Sequence
  Description of Artificial Sequence:  Enzymatic Nucleic Acid
catgtcagggctagctacaacgagtttgagt

SEQ ID NO: 19266 - DNA, 31 bp, Artificial Sequence
  Description of Artificial Sequence:  Enzymatic Nucleic Acid
cgtacatgggctagctacaacgacagcgttt

SEQ ID NO: 19267 - DNA, 31 bp, Artificial Sequence
  Description of Artificial Sequence:  Enzymatic Nucleic Acid
accgtacaggctagctacaacgagtcagcgt

SEQ ID NO: 19268 - DNA, 31 bp, Artificial Sequence
  Description of Artificial Sequence:  Enzymatic Nucleic Acid
agaccgtaggctagctacaacgaatgtcagc

SEQ ID NO: 19269 - DNA, 31 bp, Artificial Sequence
  Description of Artificial Sequence:  Enzymatic Nucleic Acid
atagaccgggctagctacaacgaacatgtca

SEQ ID NO: 19270 - DNA, 31 bp, Artificial Sequence
  Description of Artificial Sequence:  Enzymatic Nucleic Acid
ggcatagaggctagctacaacgacgtacatg

SEQ ID NO: 19271 - DNA, 31 bp, Artificial Sequence
  Description of Artificial Sequence:  Enzymatic Nucleic Acid
gaatggcaggctagctacaacgaagaccgta

SEQ ID NO: 19272 - DNA, 31 bp, Artificial Sequence
  Description of Artificial Sequence:  Enzymatic Nucleic Acid
aggaatggggctagctacaacgaatagaccg

SEQ ID NO: 19273 - DNA, 31 bp, Artificial Sequence
  Description of Artificial Sequence:  Enzymatic Nucleic Acid
gggaggaaggctagctacaacgaggcataga

SEQ ID NO: 19274 - DNA, 31 bp, Artificial Sequence
  Description of Artificial Sequence:  Enzymatic Nucleic Acid
atgtgatgggctagctacaacgagggggagg

SEQ ID NO: 19275 - DNA, 31 bp, Artificial Sequence
  Description of Artificial Sequence:  Enzymatic Nucleic Acid
ggatgtgaggctagctacaacgagcggggga

SEQ ID NO: 19276 - DNA, 31 bp, Artificial Sequence
  Description of Artificial Sequence:  Enzymatic Nucleic Acid
agtggatgggctagctacaacgagatgcggg

SEQ ID NO: 19277 - DNA, 31 bp, Artificial Sequence
  Description of Artificial Sequence:  Enzymatic Nucleic Acid
ccagtggaggctagctacaacgagtgatgcg

SEQ ID NO: 19278 - DNA, 31 bp, Artificial Sequence
  Description of Artificial Sequence:  Enzymatic Nucleic Acid
aataccagggctagctacaacgaggatgtga

SEQ ID NO: 19279 - DNA, 31 bp, Artificial Sequence
  Description of Artificial Sequence:  Enzymatic Nucleic Acid
tgccaataggctagctacaacgacagtggat

SEQ ID NO: 19280 - DNA, 31 bp, Artificial Sequence
  Description of Artificial Sequence:  Enzymatic Nucleic Acid
actgccaaggctagctacaacgaaccagtgg

SEQ ID NO: 19281 - DNA, 31 bp, Artificial Sequence
  Description of Artificial Sequence:  Enzymatic Nucleic Acid
tccaactgggctagctacaacgacaatacca

SEQ ID NO: 19282 - DNA, 31 bp, Artificial Sequence
  Description of Artificial Sequence:  Enzymatic Nucleic Acid
tcctccaaggctagctacaacgatgccaata

SEQ ID NO: 19283 - DNA, 31 bp, Artificial Sequence
  Description of Artificial Sequence:  Enzymatic Nucleic Acid
ttggcgcaggctagctacaacgatcttcctc

SEQ ID NO: 19284 - DNA, 31 bp, Artificial Sequence
  Description of Artificial Sequence:  Enzymatic Nucleic Acid
cgttggcgggctagctacaacgaactcttcc

SEQ ID NO: 19285 - DNA, 31 bp, Artificial Sequence
  Description of Artificial Sequence:  Enzymatic Nucleic Acid
ctcgttggggctagctacaacgagcactctt

SEQ ID NO: 19286 - DNA, 31 bp, Artificial Sequence
  Description of Artificial Sequence:  Enzymatic Nucleic Acid
tgggctcgggctagctacaacgatggcgcac

SEQ ID NO: 19287 - DNA, 31 bp, Artificial Sequence
  Description of Artificial Sequence:  Enzymatic Nucleic Acid
tggctgggggctagctacaacgatcgttggc

SEQ ID NO: 19288 - DNA, 31 bp, Artificial Sequence
  Description of Artificial Sequence:  Enzymatic Nucleic Acid
cagcttggggctagctacaacgatgggctcg

SEQ ID NO: 19289 - DNA, 31 bp, Artificial Sequence
  Description of Artificial Sequence:  Enzymatic Nucleic Acid
tgagacagggctagctacaacgattggctgg

SEQ ID NO: 19290 - DNA, 31 bp, Artificial Sequence
  Description of Artificial Sequence:  Enzymatic Nucleic Acid
cactgagaggctagctacaacgaagcttggc

SEQ ID NO: 19291 - DNA, 31 bp, Artificial Sequence
  Description of Artificial Sequence:  Enzymatic Nucleic Acid
gtttgtcaggctagctacaacgatgagacag

SEQ ID NO: 19292 - DNA, 31 bp, Artificial Sequence
  Description of Artificial Sequence:  Enzymatic Nucleic Acid
tgggtttgggctagctacaacgacactgaga

SEQ ID NO: 19293 - DNA, 31 bp, Artificial Sequence
  Description of Artificial Sequence:  Enzymatic Nucleic Acid
ggtatgggggctagctacaacgattgtcact

SEQ ID NO: 19294 - DNA, 31 bp, Artificial Sequence
  Description of Artificial Sequence:  Enzymatic Nucleic Acid
caagggtaggctagctacaacgagggtttgt

SEQ ID NO: 19295 - DNA, 31 bp, Artificial Sequence
  Description of Artificial Sequence:  Enzymatic Nucleic Acid
cacaagggggctagctacaacgaatgggttt

SEQ ID NO: 19296 - DNA, 31 bp, Artificial Sequence
  Description of Artificial Sequence:  Enzymatic Nucleic Acid
attcttcaggctagctacaacgaaagggtat

SEQ ID NO: 19297 - DNA, 31 bp, Artificial Sequence
  Description of Artificial Sequence:  Enzymatic Nucleic Acid
cttctccaggctagctacaacgatcttcaca

SEQ ID NO: 19298 - DNA, 31 bp, Artificial Sequence
  Description of Artificial Sequence:  Enzymatic Nucleic Acid
cctccacaggctagctacaacgattctccat

SEQ ID NO: 19299 - DNA, 31 bp, Artificial Sequence
  Description of Artificial Sequence:  Enzymatic Nucleic Acid
gtcctccaggctagctacaacgaacttctcc

SEQ ID NO: 19300 - DNA, 31 bp, Artificial Sequence
  Description of Artificial Sequence:  Enzymatic Nucleic Acid
cctggaagggctagctacaacgacctccaca

SEQ ID NO: 19301 - DNA, 31 bp, Artificial Sequence
  Description of Artificial Sequence:  Enzymatic Nucleic Acid
caattttaggctagctacaacgattcctccc

SEQ ID NO: 19302 - DNA, 31 bp, Artificial Sequence
  Description of Artificial Sequence:  Enzymatic Nucleic Acid
aacttcaaggctagctacaacgatttatttc

SEQ ID NO: 19303 - DNA, 31 bp, Artificial Sequence
  Description of Artificial Sequence:  Enzymatic Nucleic Acid
tttattaaggctagctacaacgattcaattt

SEQ ID NO: 19304 - DNA, 31 bp, Artificial Sequence
  Description of Artificial Sequence:  Enzymatic Nucleic Acid
gatttttaggctagctacaacgataacttca

SEQ ID NO: 19305 - DNA, 31 bp, Artificial Sequence
  Description of Artificial Sequence:  Enzymatic Nucleic Acid
caaattgaggctagctacaacgattttatta

SEQ ID NO: 19306 - DNA, 31 bp, Artificial Sequence
  Description of Artificial Sequence:  Enzymatic Nucleic Acid
agagcaaaggctagctacaacgatgattttt

SEQ ID NO: 19307 - DNA, 31 bp, Artificial Sequence
  Description of Artificial Sequence:  Enzymatic Nucleic Acid
aattagagggctagctacaacgaaaattgat

SEQ ID NO: 19308 - DNA, 31 bp, Artificial Sequence
  Description of Artificial Sequence:  Enzymatic Nucleic Acid
tccttcaaggctagctacaacgatagagcaa

SEQ ID NO: 19309 - DNA, 31 bp, Artificial Sequence
  Description of Artificial Sequence:  Enzymatic Nucleic Acid
cagttttgggctagctacaacgatttttcct

SEQ ID NO: 19310 - DNA, 31 bp, Artificial Sequence
  Description of Artificial Sequence:  Enzymatic Nucleic Acid
acttacagggctagctacaacgatttgtttt

SEQ ID NO: 19311 - DNA, 31 bp, Artificial Sequence
  Description of Artificial Sequence:  Enzymatic Nucleic Acid
ggtacttaggctagctacaacgaagttttgt

SEQ ID NO: 19312 - DNA, 31 bp, Artificial Sequence
  Description of Artificial Sequence:  Enzymatic Nucleic Acid
caagggtaggctagctacaacgattacagtt

SEQ ID NO: 19313 - DNA, 31 bp, Artificial Sequence
  Description of Artificial Sequence:  Enzymatic Nucleic Acid
aacaagggggctagctacaacgaacttacag

SEQ ID NO: 19314 - DNA, 31 bp, Artificial Sequence
  Description of Artificial Sequence:  Enzymatic Nucleic Acid
ttggataaggctagctacaacgaaagggtac

SEQ ID NO: 19315 - DNA, 31 bp, Artificial Sequence
  Description of Artificial Sequence:  Enzymatic Nucleic Acid
cgcttggaggctagctacaacgaaacaaggg

SEQ ID NO: 19316 - DNA, 31 bp, Artificial Sequence
  Description of Artificial Sequence:  Enzymatic Nucleic Acid
atttgccgggctagctacaacgattggataa

SEQ ID NO: 19317 - DNA, 31 bp, Artificial Sequence
  Description of Artificial Sequence:  Enzymatic Nucleic Acid
cacatttgggctagctacaacgacgcttgga

SEQ ID NO: 19318 - DNA, 31 bp, Artificial Sequence
  Description of Artificial Sequence:  Enzymatic Nucleic Acid
ctgacacaggctagctacaacgattgccgct

SEQ ID NO: 19319 - DNA, 31 bp, Artificial Sequence
  Description of Artificial Sequence:  Enzymatic Nucleic Acid
agctgacaggctagctacaacgaatttgccg

SEQ ID NO: 19320 - DNA, 31 bp, Artificial Sequence
  Description of Artificial Sequence:  Enzymatic Nucleic Acid
aaagctgaggctagctacaacgaacatttgc

SEQ ID NO: 19321 - DNA, 31 bp, Artificial Sequence
  Description of Artificial Sequence:  Enzymatic Nucleic Acid
gtacaaagggctagctacaacgatgacacat

SEQ ID NO: 19322 - DNA, 31 bp, Artificial Sequence
  Description of Artificial Sequence:  Enzymatic Nucleic Acid
catttgtaggctagctacaacgaaaagctga

SEQ ID NO: 19323 - DNA, 31 bp, Artificial Sequence
  Description of Artificial Sequence:  Enzymatic Nucleic Acid
cacatttgggctagctacaacgaacaaagct

SEQ ID NO: 19324 - DNA, 31 bp, Artificial Sequence
  Description of Artificial Sequence:  Enzymatic Nucleic Acid
gcttcacaggctagctacaacgattgtacaa

SEQ ID NO: 19325 - DNA, 31 bp, Artificial Sequence
  Description of Artificial Sequence:  Enzymatic Nucleic Acid
ccgcttcaggctagctacaacgaatttgtac

SEQ ID NO: 19326 - DNA, 31 bp, Artificial Sequence
  Description of Artificial Sequence:  Enzymatic Nucleic Acid
gttgaccgggctagctacaacgattcacatt

SEQ ID NO: 19327 - DNA, 31 bp, Artificial Sequence
  Description of Artificial Sequence:  Enzymatic Nucleic Acid
tttgttgaggctagctacaacgacgcttcac

SEQ ID NO: 19328 - DNA, 31 bp, Artificial Sequence
  Description of Artificial Sequence:  Enzymatic Nucleic Acid
cgactttgggctagctacaacgatgaccgct

SEQ ID NO: 19329 - DNA, 31 bp, Artificial Sequence
  Description of Artificial Sequence:  Enzymatic Nucleic Acid
tctcccgaggctagctacaacgatttgttga

SEQ ID NO: 19330 - DNA, 31 bp, Artificial Sequence
  Description of Artificial Sequence:  Enzymatic Nucleic Acid
ggagatcaggctagctacaacgacctctctc

SEQ ID NO: 19331 - DNA, 31 bp, Artificial Sequence
  Description of Artificial Sequence:  Enzymatic Nucleic Acid
gaaggagaggctagctacaacgacaccctct

SEQ ID NO: 19332 - DNA, 31 bp, Artificial Sequence
  Description of Artificial Sequence:  Enzymatic Nucleic Acid
tggtcacgggctagctacaacgaggaaggag

SEQ ID NO: 19333 - DNA, 31 bp, Artificial Sequence
  Description of Artificial Sequence:  Enzymatic Nucleic Acid
cctggtcaggctagctacaacgagtggaagg

SEQ ID NO: 19334 - DNA, 31 bp, Artificial Sequence
  Description of Artificial Sequence:  Enzymatic Nucleic Acid
acccctggggctagctacaacgacacgtgga

SEQ ID NO: 19335 - DNA, 31 bp, Artificial Sequence
  Description of Artificial Sequence:  Enzymatic Nucleic Acid
tttcaggaggctagctacaacgaccctggtc

SEQ ID NO: 19336 - DNA, 31 bp, Artificial Sequence
  Description of Artificial Sequence:  Enzymatic Nucleic Acid
caaagtaaggctagctacaacgattcaggac

SEQ ID NO: 19337 - DNA, 31 bp, Artificial Sequence
  Description of Artificial Sequence:  Enzymatic Nucleic Acid
ttgcaaagggctagctacaacgaaatttcag

SEQ ID NO: 19338 - DNA, 31 bp, Artificial Sequence
  Description of Artificial Sequence:  Enzymatic Nucleic Acid
tcaggttgggctagctacaacgaaaagtaat

SEQ ID NO: 19339 - DNA, 31 bp, Artificial Sequence
  Description of Artificial Sequence:  Enzymatic Nucleic Acid
atgtcaggggctagctacaacgatgcaaagt

SEQ ID NO: 19340 - DNA, 31 bp, Artificial Sequence
  Description of Artificial Sequence:  Enzymatic Nucleic Acid
gctgcatgggctagctacaacgacaggttgc

SEQ ID NO: 19341 - DNA, 31 bp, Artificial Sequence
  Description of Artificial Sequence:  Enzymatic Nucleic Acid
gggctgcaggctagctacaacgagtcaggtt

SEQ ID NO: 19342 - DNA, 31 bp, Artificial Sequence
  Description of Artificial Sequence:  Enzymatic Nucleic Acid
gtgggctgggctagctacaacgaatgtcagg

SEQ ID NO: 19343 - DNA, 31 bp, Artificial Sequence
  Description of Artificial Sequence:  Enzymatic Nucleic Acid
tcagtgggggctagctacaacgatgcatgtc

SEQ ID NO: 19344 - DNA, 31 bp, Artificial Sequence
  Description of Artificial Sequence:  Enzymatic Nucleic Acid
ctgctcagggctagctacaacgagggctgca

SEQ ID NO: 19345 - DNA, 31 bp, Artificial Sequence
  Description of Artificial Sequence:  Enzymatic Nucleic Acid
ctctcctgggctagctacaacgatcagtggg

SEQ ID NO: 19346 - DNA, 31 bp, Artificial Sequence
  Description of Artificial Sequence:  Enzymatic Nucleic Acid
aagacacgggctagctacaacgatctcctgc

SEQ ID NO: 19347 - DNA, 31 bp, Artificial Sequence
  Description of Artificial Sequence:  Enzymatic Nucleic Acid
caaagacaggctagctacaacgagctctcct

SEQ ID NO: 19348 - DNA, 31 bp, Artificial Sequence
  Description of Artificial Sequence:  Enzymatic Nucleic Acid
cacaaagaggctagctacaacgaacgctctc

SEQ ID NO: 19349 - DNA, 31 bp, Artificial Sequence
  Description of Artificial Sequence:  Enzymatic Nucleic Acid
gtgcaccaggctagctacaacgaaaagacac

SEQ ID NO: 19350 - DNA, 31 bp, Artificial Sequence
  Description of Artificial Sequence:  Enzymatic Nucleic Acid
gcagtgcaggctagctacaacgacacaaaga

SEQ ID NO: 19351 - DNA, 31 bp, Artificial Sequence
  Description of Artificial Sequence:  Enzymatic Nucleic Acid
ctgcagtgggctagctacaacgaaccacaaa

SEQ ID NO: 19352 - DNA, 31 bp, Artificial Sequence
  Description of Artificial Sequence:  Enzymatic Nucleic Acid
gtctgcagggctagctacaacgagcaccaca

SEQ ID NO: 19353 - DNA, 31 bp, Artificial Sequence
  Description of Artificial Sequence:  Enzymatic Nucleic Acid
tctgtctgggctagctacaacgaagtgcacc

SEQ ID NO: 19354 - DNA, 31 bp, Artificial Sequence
  Description of Artificial Sequence:  Enzymatic Nucleic Acid
tagatctgggctagctacaacgactgcagtg

SEQ ID NO: 19355 - DNA, 31 bp, Artificial Sequence
  Description of Artificial Sequence:  Enzymatic Nucleic Acid
aacgtagaggctagctacaacgactgtctgc

SEQ ID NO: 19356 - DNA, 31 bp, Artificial Sequence
  Description of Artificial Sequence:  Enzymatic Nucleic Acid
ctcaaacgggctagctacaacgaagatctgt

SEQ ID NO: 19357 - DNA, 31 bp, Artificial Sequence
  Description of Artificial Sequence:  Enzymatic Nucleic Acid
ttctcaaaggctagctacaacgagtagatct

SEQ ID NO: 19358 - DNA, 31 bp, Artificial Sequence
  Description of Artificial Sequence:  Enzymatic Nucleic Acid
atgtgaggggctagctacaacgatctcaaac

SEQ ID NO: 19359 - DNA, 31 bp, Artificial Sequence
  Description of Artificial Sequence:  Enzymatic Nucleic Acid
gtaccatgggctagctacaacgagaggttct

SEQ ID NO: 19360 - DNA, 31 bp, Artificial Sequence
  Description of Artificial Sequence:  Enzymatic Nucleic Acid
ttgtaccaggctagctacaacgagtgaggtt

SEQ ID NO: 19361 - DNA, 31 bp, Artificial Sequence
  Description of Artificial Sequence:  Enzymatic Nucleic Acid
agcttgtaggctagctacaacgacatgtgag

SEQ ID NO: 19362 - DNA, 31 bp, Artificial Sequence
  Description of Artificial Sequence:  Enzymatic Nucleic Acid
caagcttgggctagctacaacgaaccatgtg

SEQ ID NO: 19363 - DNA, 31 bp, Artificial Sequence
  Description of Artificial Sequence:  Enzymatic Nucleic Acid
gggccaagggctagctacaacgattgtacca

SEQ ID NO: 19364 - DNA, 31 bp, Artificial Sequence
  Description of Artificial Sequence:  Enzymatic Nucleic Acid
gctgtgggggctagctacaacgacaagcttg

SEQ ID NO: 19365 - DNA, 31 bp, Artificial Sequence
  Description of Artificial Sequence:  Enzymatic Nucleic Acid
agaggctgggctagctacaacgagggccaag

SEQ ID NO: 19366 - DNA, 31 bp, Artificial Sequence
  Description of Artificial Sequence:  Enzymatic Nucleic Acid
ggcagaggggctagctacaacgatgtgggcc

SEQ ID NO: 19367 - DNA, 31 bp, Artificial Sequence
  Description of Artificial Sequence:  Enzymatic Nucleic Acid
tggattggggctagctacaacgaagaggctg

SEQ ID NO: 19368 - DNA, 31 bp, Artificial Sequence
  Description of Artificial Sequence:  Enzymatic Nucleic Acid
cacatggaggctagctacaacgatggcagag

SEQ ID NO: 19369 - DNA, 31 bp, Artificial Sequence
  Description of Artificial Sequence:  Enzymatic Nucleic Acid
ctcccacaggctagctacaacgaggattggc

SEQ ID NO: 19370 - DNA, 31 bp, Artificial Sequence
  Description of Artificial Sequence:  Enzymatic Nucleic Acid
ctctcccaggctagctacaacgaatggattg

SEQ ID NO: 19371 - DNA, 31 bp, Artificial Sequence
  Description of Artificial Sequence:  Enzymatic Nucleic Acid
gtgggcaaggctagctacaacgatctcccac

SEQ ID NO: 19372 - DNA, 31 bp, Artificial Sequence
  Description of Artificial Sequence:  Enzymatic Nucleic Acid
ggtgtgggggctagctacaacgaaactctcc

SEQ ID NO: 19373 - DNA, 31 bp, Artificial Sequence
  Description of Artificial Sequence:  Enzymatic Nucleic Acid
aacaggtgggctagctacaacgagggcaact

SEQ ID NO: 19374 - DNA, 31 bp, Artificial Sequence
  Description of Artificial Sequence:  Enzymatic Nucleic Acid
caaacaggggctagctacaacgagtgggcaa

SEQ ID NO: 19375 - DNA, 31 bp, Artificial Sequence
  Description of Artificial Sequence:  Enzymatic Nucleic Acid
cttgcaaaggctagctacaacgaaggtgtgg

SEQ ID NO: 19376 - DNA, 31 bp, Artificial Sequence
  Description of Artificial Sequence:  Enzymatic Nucleic Acid
agttcttgggctagctacaacgaaaacaggt

SEQ ID NO: 19377 - DNA, 31 bp, Artificial Sequence
  Description of Artificial Sequence:  Enzymatic Nucleic Acid
tatccaagggctagctacaacgatcttgcaa

SEQ ID NO: 19378 - DNA, 31 bp, Artificial Sequence
  Description of Artificial Sequence:  Enzymatic Nucleic Acid
aaagagtaggctagctacaacgaccaagttc

SEQ ID NO: 19379 - DNA, 31 bp, Artificial Sequence
  Description of Artificial Sequence:  Enzymatic Nucleic Acid
ccaaagagggctagctacaacgaatccaagt

SEQ ID NO: 19380 - DNA, 31 bp, Artificial Sequence
  Description of Artificial Sequence:  Enzymatic Nucleic Acid
gcattcaaggctagctacaacgattccaaag

SEQ ID NO: 19381 - DNA, 31 bp, Artificial Sequence
  Description of Artificial Sequence:  Enzymatic Nucleic Acid
tggtggcaggctagctacaacgatcaatttc

SEQ ID NO: 19382 - DNA, 31 bp, Artificial Sequence
  Description of Artificial Sequence:  Enzymatic Nucleic Acid
catggtggggctagctacaacgaattcaatt

SEQ ID NO: 19383 - DNA, 31 bp, Artificial Sequence
  Description of Artificial Sequence:  Enzymatic Nucleic Acid
gaacatggggctagctacaacgaggcattca

SEQ ID NO: 19384 - DNA, 31 bp, Artificial Sequence
  Description of Artificial Sequence:  Enzymatic Nucleic Acid
agagaacaggctagctacaacgaggtggcat

SEQ ID NO: 19385 - DNA, 31 bp, Artificial Sequence
  Description of Artificial Sequence:  Enzymatic Nucleic Acid
ttagagaaggctagctacaacgaatggtggc

SEQ ID NO: 19386 - DNA, 31 bp, Artificial Sequence
  Description of Artificial Sequence:  Enzymatic Nucleic Acid
ttgtgctaggctagctacaacgatagagaac

SEQ ID NO: 19387 - DNA, 31 bp, Artificial Sequence
  Description of Artificial Sequence:  Enzymatic Nucleic Acid
catttgtgggctagctacaacgatattagag

SEQ ID NO: 19388 - DNA, 31 bp, Artificial Sequence
  Description of Artificial Sequence:  Enzymatic Nucleic Acid
gtcatttgggctagctacaacgagctattag

SEQ ID NO: 19389 - DNA, 31 bp, Artificial Sequence
  Description of Artificial Sequence:  Enzymatic Nucleic Acid
aaatgtcaggctagctacaacgattgtgcta

SEQ ID NO: 19390 - DNA, 31 bp, Artificial Sequence
  Description of Artificial Sequence:  Enzymatic Nucleic Acid
tcaaaatgggctagctacaacgacatttgtg

SEQ ID NO: 19391 - DNA, 31 bp, Artificial Sequence
  Description of Artificial Sequence:  Enzymatic Nucleic Acid
gatcaaaaggctagctacaacgagtcatttg

SEQ ID NO: 19392 - DNA, 31 bp, Artificial Sequence
  Description of Artificial Sequence:  Enzymatic Nucleic Acid
ctccatgaggctagctacaacgacaaaatgt

SEQ ID NO: 19393 - DNA, 31 bp, Artificial Sequence
  Description of Artificial Sequence:  Enzymatic Nucleic Acid
aagctccaggctagctacaacgagatcaaaa

SEQ ID NO: 19394 - DNA, 31 bp, Artificial Sequence
  Description of Artificial Sequence:  Enzymatic Nucleic Acid
ttcttaagggctagctacaacgatccatgat

SEQ ID NO: 19395 - DNA, 31 bp, Artificial Sequence
  Description of Artificial Sequence:  Enzymatic Nucleic Acid
aggatgcaggctagctacaacgatcttaagc

SEQ ID NO: 19396 - DNA, 31 bp, Artificial Sequence
  Description of Artificial Sequence:  Enzymatic Nucleic Acid
caaggatgggctagctacaacgaattcttaa

SEQ ID NO: 19397 - DNA, 31 bp, Artificial Sequence
  Description of Artificial Sequence:  Enzymatic Nucleic Acid
tgcaaggaggctagctacaacgagcattctt

SEQ ID NO: 19398 - DNA, 31 bp, Artificial Sequence
  Description of Artificial Sequence:  Enzymatic Nucleic Acid
tggtcctgggctagctacaacgaaaggatgc

SEQ ID NO: 19399 - DNA, 31 bp, Artificial Sequence
  Description of Artificial Sequence:  Enzymatic Nucleic Acid
ctccttggggctagctacaacgacctgcaag

SEQ ID NO: 19400 - DNA, 31 bp, Artificial Sequence
  Description of Artificial Sequence:  Enzymatic Nucleic Acid
agacatagggctagctacaacgactccttgg

SEQ ID NO: 19401 - DNA, 31 bp, Artificial Sequence
  Description of Artificial Sequence:  Enzymatic Nucleic Acid
ggcagacaggctagctacaacgaagtctcct

SEQ ID NO: 19402 - DNA, 31 bp, Artificial Sequence
  Description of Artificial Sequence:  Enzymatic Nucleic Acid
aaggcagaggctagctacaacgaatagtctc

SEQ ID NO: 19403 - DNA, 31 bp, Artificial Sequence
  Description of Artificial Sequence:  Enzymatic Nucleic Acid
gagcaaggggctagctacaacgaagacatag

SEQ ID NO: 19404 - DNA, 31 bp, Artificial Sequence
  Description of Artificial Sequence:  Enzymatic Nucleic Acid
gtcttgagggctagctacaacgaaaggcaga

SEQ ID NO: 19405 - DNA, 31 bp, Artificial Sequence
  Description of Artificial Sequence:  Enzymatic Nucleic Acid
tcttcctgggctagctacaacgacttgagca

SEQ ID NO: 19406 - DNA, 31 bp, Artificial Sequence
  Description of Artificial Sequence:  Enzymatic Nucleic Acid
tttcttggggctagctacaacgacttcctgt

SEQ ID NO: 19407 - DNA, 31 bp, Artificial Sequence
  Description of Artificial Sequence:  Enzymatic Nucleic Acid
acgcaatgggctagctacaacgacttttctt

SEQ ID NO: 19408 - DNA, 31 bp, Artificial Sequence
  Description of Artificial Sequence:  Enzymatic Nucleic Acid
ccacgcaaggctagctacaacgagtcttttc

SEQ ID NO: 19409 - DNA, 31 bp, Artificial Sequence
  Description of Artificial Sequence:  Enzymatic Nucleic Acid
tgaccacgggctagctacaacgaaatgtctt

SEQ ID NO: 19410 - DNA, 31 bp, Artificial Sequence
  Description of Artificial Sequence:  Enzymatic Nucleic Acid
cctgaccaggctagctacaacgagcaatgtc

SEQ ID NO: 19411 - DNA, 31 bp, Artificial Sequence
  Description of Artificial Sequence:  Enzymatic Nucleic Acid
ctgcctgaggctagctacaacgacacgcaat

SEQ ID NO: 19412 - DNA, 31 bp, Artificial Sequence
  Description of Artificial Sequence:  Enzymatic Nucleic Acid
gtgagctgggctagctacaacgactgaccac

SEQ ID NO: 19413 - DNA, 31 bp, Artificial Sequence
  Description of Artificial Sequence:  Enzymatic Nucleic Acid
actgtgagggctagctacaacgatgcctgac

SEQ ID NO: 19414 - DNA, 31 bp, Artificial Sequence
  Description of Artificial Sequence:  Enzymatic Nucleic Acid
taggactgggctagctacaacgagagctgcc

SEQ ID NO: 19415 - DNA, 31 bp, Artificial Sequence
  Description of Artificial Sequence:  Enzymatic Nucleic Acid
ctctaggaggctagctacaacgatgtgagct

SEQ ID NO: 19416 - DNA, 31 bp, Artificial Sequence
  Description of Artificial Sequence:  Enzymatic Nucleic Acid
gccacacgggctagctacaacgatctaggac

SEQ ID NO: 19417 - DNA, 31 bp, Artificial Sequence
  Description of Artificial Sequence:  Enzymatic Nucleic Acid
gtgccacaggctagctacaacgagctctagg

SEQ ID NO: 19418 - DNA, 31 bp, Artificial Sequence
  Description of Artificial Sequence:  Enzymatic Nucleic Acid
gggtgccaggctagctacaacgaacgctcta

SEQ ID NO: 19419 - DNA, 31 bp, Artificial Sequence
  Description of Artificial Sequence:  Enzymatic Nucleic Acid
cgtgggtgggctagctacaacgacacacgct

SEQ ID NO: 19420 - DNA, 31 bp, Artificial Sequence
  Description of Artificial Sequence:  Enzymatic Nucleic Acid
atcgtgggggctagctacaacgagccacacg

SEQ ID NO: 19421 - DNA, 31 bp, Artificial Sequence
  Description of Artificial Sequence:  Enzymatic Nucleic Acid
tgtgatcgggctagctacaacgagggtgcca

SEQ ID NO: 19422 - DNA, 31 bp, Artificial Sequence
  Description of Artificial Sequence:  Enzymatic Nucleic Acid
tcctgtgaggctagctacaacgacgtgggtg

SEQ ID NO: 19423 - DNA, 31 bp, Artificial Sequence
  Description of Artificial Sequence:  Enzymatic Nucleic Acid
gtttcctgggctagctacaacgagatcgtgg

SEQ ID NO: 19424 - DNA, 31 bp, Artificial Sequence
  Description of Artificial Sequence:  Enzymatic Nucleic Acid
tctccaggggctagctacaacgattcctgtg

SEQ ID NO: 19425 - DNA, 31 bp, Artificial Sequence
  Description of Artificial Sequence:  Enzymatic Nucleic Acid
tcgtctgaggctagctacaacgatctccagg

SEQ ID NO: 19426 - DNA, 31 bp, Artificial Sequence
  Description of Artificial Sequence:  Enzymatic Nucleic Acid
acttgtcgggctagctacaacgactgattct

SEQ ID NO: 19427 - DNA, 31 bp, Artificial Sequence
  Description of Artificial Sequence:  Enzymatic Nucleic Acid
aatacttgggctagctacaacgacgtctgat

SEQ ID NO: 19428 - DNA, 31 bp, Artificial Sequence
  Description of Artificial Sequence:  Enzymatic Nucleic Acid
ccccaataggctagctacaacgattgtcgtc

SEQ ID NO: 19429 - DNA, 31 bp, Artificial Sequence
  Description of Artificial Sequence:  Enzymatic Nucleic Acid
ttccccaaggctagctacaacgaacttgtcg

SEQ ID NO: 19430 - DNA, 31 bp, Artificial Sequence
  Description of Artificial Sequence:  Enzymatic Nucleic Acid
cttcgatgggctagctacaacgatttcccca

SEQ ID NO: 19431 - DNA, 31 bp, Artificial Sequence
  Description of Artificial Sequence:  Enzymatic Nucleic Acid
gacttcgaggctagctacaacgagctttccc

SEQ ID NO: 19432 - DNA, 31 bp, Artificial Sequence
  Description of Artificial Sequence:  Enzymatic Nucleic Acid
gcatgagaggctagctacaacgattcgatgc

SEQ ID NO: 19433 - DNA, 31 bp, Artificial Sequence
  Description of Artificial Sequence:  Enzymatic Nucleic Acid
gccgtgcaggctagctacaacgagagacttc

SEQ ID NO: 19434 - DNA, 31 bp, Artificial Sequence
  Description of Artificial Sequence:  Enzymatic Nucleic Acid
atgccgtgggctagctacaacgaatgagact

SEQ ID NO: 19435 - DNA, 31 bp, Artificial Sequence
  Description of Artificial Sequence:  Enzymatic Nucleic Acid
agatgccgggctagctacaacgagcatgaga

SEQ ID NO: 19436 - DNA, 31 bp, Artificial Sequence
  Description of Artificial Sequence:  Enzymatic Nucleic Acid
cccagatgggctagctacaacgacgtgcatg

SEQ ID NO: 19437 - DNA, 31 bp, Artificial Sequence
  Description of Artificial Sequence:  Enzymatic Nucleic Acid
ttcccagaggctagctacaacgagccgtgca

SEQ ID NO: 19438 - DNA, 31 bp, Artificial Sequence
  Description of Artificial Sequence:  Enzymatic Nucleic Acid
gagggggaggctagctacaacgatcccagat

SEQ ID NO: 19439 - DNA, 31 bp, Artificial Sequence
  Description of Artificial Sequence:  Enzymatic Nucleic Acid
atgatctgggctagctacaacgaggaggggg

SEQ ID NO: 19440 - DNA, 31 bp, Artificial Sequence
  Description of Artificial Sequence:  Enzymatic Nucleic Acid
ccacatgaggctagctacaacgactgtggag

SEQ ID NO: 19441 - DNA, 31 bp, Artificial Sequence
  Description of Artificial Sequence:  Enzymatic Nucleic Acid
aaaccacaggctagctacaacgagatctgtg

SEQ ID NO: 19442 - DNA, 31 bp, Artificial Sequence
  Description of Artificial Sequence:  Enzymatic Nucleic Acid
ttaaaccaggctagctacaacgaatgatctg

SEQ ID NO: 19443 - DNA, 31 bp, Artificial Sequence
  Description of Artificial Sequence:  Enzymatic Nucleic Acid
tctttaaaggctagctacaacgacacatgat

SEQ ID NO: 19444 - DNA, 31 bp, Artificial Sequence
  Description of Artificial Sequence:  Enzymatic Nucleic Acid
tctcattaggctagctacaacgactttaaac

SEQ ID NO: 19445 - DNA, 31 bp, Artificial Sequence
  Description of Artificial Sequence:  Enzymatic Nucleic Acid
gggtctcaggctagctacaacgatatcttta

SEQ ID NO: 19446 - DNA, 31 bp, Artificial Sequence
  Description of Artificial Sequence:  Enzymatic Nucleic Acid
tacaagggggctagctacaacgactcattat

SEQ ID NO: 19447 - DNA, 31 bp, Artificial Sequence
  Description of Artificial Sequence:  Enzymatic Nucleic Acid
gtcttctaggctagctacaacgaaagggtct

SEQ ID NO: 19448 - DNA, 31 bp, Artificial Sequence
  Description of Artificial Sequence:  Enzymatic Nucleic Acid
tgcctgagggctagctacaacgacttctaca

SEQ ID NO: 19449 - DNA, 31 bp, Artificial Sequence
  Description of Artificial Sequence:  Enzymatic Nucleic Acid
atacaatgggctagctacaacgactgagtct

SEQ ID NO: 19450 - DNA, 31 bp, Artificial Sequence
  Description of Artificial Sequence:  Enzymatic Nucleic Acid
caatacaaggctagctacaacgagcctgagt

SEQ ID NO: 19451 - DNA, 31 bp, Artificial Sequence
  Description of Artificial Sequence:  Enzymatic Nucleic Acid
cttcaataggctagctacaacgaaatgcctg

SEQ ID NO: 19452 - DNA, 31 bp, Artificial Sequence
  Description of Artificial Sequence:  Enzymatic Nucleic Acid
tccttcaaggctagctacaacgaacaatgcc

SEQ ID NO: 19453 - DNA, 31 bp, Artificial Sequence
  Description of Artificial Sequence:  Enzymatic Nucleic Acid
ggttcccaggctagctacaacgaccttcaat

SEQ ID NO: 19454 - DNA, 31 bp, Artificial Sequence
  Description of Artificial Sequence:  Enzymatic Nucleic Acid
ggttccggggctagctacaacgatcccatcc

SEQ ID NO: 19455 - DNA, 31 bp, Artificial Sequence
  Description of Artificial Sequence:  Enzymatic Nucleic Acid
tagtgaggggctagctacaacgatccggttc

SEQ ID NO: 19456 - DNA, 31 bp, Artificial Sequence
  Description of Artificial Sequence:  Enzymatic Nucleic Acid
gcggatagggctagctacaacgagaggttcc

SEQ ID NO: 19457 - DNA, 31 bp, Artificial Sequence
  Description of Artificial Sequence:  Enzymatic Nucleic Acid
tctgcggaggctagctacaacgaagtgaggt

SEQ ID NO: 19458 - DNA, 31 bp, Artificial Sequence
  Description of Artificial Sequence:  Enzymatic Nucleic Acid
tcactctgggctagctacaacgaggatagtg

SEQ ID NO: 19459 - DNA, 31 bp, Artificial Sequence
  Description of Artificial Sequence:  Enzymatic Nucleic Acid
cttcctcaggctagctacaacgatctgcgga

SEQ ID NO: 19460 - DNA, 31 bp, Artificial Sequence
  Description of Artificial Sequence:  Enzymatic Nucleic Acid
ggccttcgggctagctacaacgacctccttc

SEQ ID NO: 19461 - DNA, 31 bp, Artificial Sequence
  Description of Artificial Sequence:  Enzymatic Nucleic Acid
tgtagaggggctagctacaacgacttcgtcc

SEQ ID NO: 19462 - DNA, 31 bp, Artificial Sequence
  Description of Artificial Sequence:  Enzymatic Nucleic Acid
ggcaggtgggctagctacaacgaagaggcct

SEQ ID NO: 19463 - DNA, 31 bp, Artificial Sequence
  Description of Artificial Sequence:  Enzymatic Nucleic Acid
ctggcaggggctagctacaacgagtagaggc

SEQ ID NO: 19464 - DNA, 31 bp, Artificial Sequence
  Description of Artificial Sequence:  Enzymatic Nucleic Acid
atgcctggggctagctacaacgaaggtgtag

SEQ ID NO: 19465 - DNA, 31 bp, Artificial Sequence
  Description of Artificial Sequence:  Enzymatic Nucleic Acid
actgcatgggctagctacaacgactggcagg

SEQ ID NO: 19466 - DNA, 31 bp, Artificial Sequence
  Description of Artificial Sequence:  Enzymatic Nucleic Acid
acactgcaggctagctacaacgagcctggca

SEQ ID NO: 19467 - DNA, 31 bp, Artificial Sequence
  Description of Artificial Sequence:  Enzymatic Nucleic Acid
gaacactgggctagctacaacgaatgcctgg

SEQ ID NO: 19468 - DNA, 31 bp, Artificial Sequence
  Description of Artificial Sequence:  Enzymatic Nucleic Acid
caagaacaggctagctacaacgatgcatgcc

SEQ ID NO: 19469 - DNA, 31 bp, Artificial Sequence
  Description of Artificial Sequence:  Enzymatic Nucleic Acid
gccaagaaggctagctacaacgaactgcatg

SEQ ID NO: 19470 - DNA, 31 bp, Artificial Sequence
  Description of Artificial Sequence:  Enzymatic Nucleic Acid
ttgcacagggctagctacaacgacaagaaca

SEQ ID NO: 19471 - DNA, 31 bp, Artificial Sequence
  Description of Artificial Sequence:  Enzymatic Nucleic Acid
cttttgcaggctagctacaacgaagccaaga

SEQ ID NO: 19472 - DNA, 31 bp, Artificial Sequence
  Description of Artificial Sequence:  Enzymatic Nucleic Acid
cacttttgggctagctacaacgaacagccaa

SEQ ID NO: 19473 - DNA, 31 bp, Artificial Sequence
  Description of Artificial Sequence:  Enzymatic Nucleic Acid
tgcctccaggctagctacaacgattttgcac

SEQ ID NO: 19474 - DNA, 31 bp, Artificial Sequence
  Description of Artificial Sequence:  Enzymatic Nucleic Acid
gaaaaatgggctagctacaacgactccactt

SEQ ID NO: 19475 - DNA, 31 bp, Artificial Sequence
  Description of Artificial Sequence:  Enzymatic Nucleic Acid
atgaaaaaggctagctacaacgagcctccac

SEQ ID NO: 19476 - DNA, 31 bp, Artificial Sequence
  Description of Artificial Sequence:  Enzymatic Nucleic Acid
ttctattaggctagctacaacgagaaaaatg

SEQ ID NO: 19477 - DNA, 31 bp, Artificial Sequence
  Description of Artificial Sequence:  Enzymatic Nucleic Acid
accttctaggctagctacaacgatatgaaaa

SEQ ID NO: 19478 - DNA, 31 bp, Artificial Sequence
  Description of Artificial Sequence:  Enzymatic Nucleic Acid
cctgggcaggctagctacaacgacttctatt

SEQ ID NO: 19479 - DNA, 31 bp, Artificial Sequence
  Description of Artificial Sequence:  Enzymatic Nucleic Acid
ttcctgggggctagctacaacgaaccttcta

SEQ ID NO: 19480 - DNA, 31 bp, Artificial Sequence
  Description of Artificial Sequence:  Enzymatic Nucleic Acid
caagttcgggctagctacaacgacttttcct

SEQ ID NO: 19481 - DNA, 31 bp, Artificial Sequence
  Description of Artificial Sequence:  Enzymatic Nucleic Acid
tttccaagggctagctacaacgatcgtcttt

SEQ ID NO: 19482 - DNA, 31 bp, Artificial Sequence
  Description of Artificial Sequence:  Enzymatic Nucleic Acid
aataatgaggctagctacaacgattccaagt

SEQ ID NO: 19483 - DNA, 31 bp, Artificial Sequence
  Description of Artificial Sequence:  Enzymatic Nucleic Acid
tagaataaggctagctacaacgagatttcca

SEQ ID NO: 19484 - DNA, 31 bp, Artificial Sequence
  Description of Artificial Sequence:  Enzymatic Nucleic Acid
tactagaaggctagctacaacgaaatgattt

SEQ ID NO: 19485 - DNA, 31 bp, Artificial Sequence
  Description of Artificial Sequence:  Enzymatic Nucleic Acid
cgtgcctaggctagctacaacgatagaataa

SEQ ID NO: 19486 - DNA, 31 bp, Artificial Sequence
  Description of Artificial Sequence:  Enzymatic Nucleic Acid
ccgccgtgggctagctacaacgactactaga

SEQ ID NO: 19487 - DNA, 31 bp, Artificial Sequence
  Description of Artificial Sequence:  Enzymatic Nucleic Acid
caccgccgggctagctacaacgagcctacta

SEQ ID NO: 19488 - DNA, 31 bp, Artificial Sequence
  Description of Artificial Sequence:  Enzymatic Nucleic Acid
aatcaccgggctagctacaacgacgtgccta

SEQ ID NO: 19489 - DNA, 31 bp, Artificial Sequence
  Description of Artificial Sequence:  Enzymatic Nucleic Acid
ggcaatcaggctagctacaacgacgccgtgc

SEQ ID NO: 19490 - DNA, 31 bp, Artificial Sequence
  Description of Artificial Sequence:  Enzymatic Nucleic Acid
catggcaaggctagctacaacgacaccgccg

SEQ ID NO: 19491 - DNA, 31 bp, Artificial Sequence
  Description of Artificial Sequence:  Enzymatic Nucleic Acid
gaacatggggctagctacaacgaaatcaccg

SEQ ID NO: 19492 - DNA, 31 bp, Artificial Sequence
  Description of Artificial Sequence:  Enzymatic Nucleic Acid
gaagaacaggctagctacaacgaggcaatca

SEQ ID NO: 19493 - DNA, 31 bp, Artificial Sequence
  Description of Artificial Sequence:  Enzymatic Nucleic Acid
cagaagaaggctagctacaacgaatggcaat

SEQ ID NO: 19494 - DNA, 31 bp, Artificial Sequence
  Description of Artificial Sequence:  Enzymatic Nucleic Acid
agaagtagggctagctacaacgacagaagaa

SEQ ID NO: 19495 - DNA, 31 bp, Artificial Sequence
  Description of Artificial Sequence:  Enzymatic Nucleic Acid
acaagaagggctagctacaacgaagccagaa

SEQ ID NO: 19496 - DNA, 31 bp, Artificial Sequence
  Description of Artificial Sequence:  Enzymatic Nucleic Acid
gatgatgaggctagctacaacgaaagaagta

SEQ ID NO: 19497 - DNA, 31 bp, Artificial Sequence
  Description of Artificial Sequence:  Enzymatic Nucleic Acid
taggatgaggctagctacaacgagacaagaa

SEQ ID NO: 19498 - DNA, 31 bp, Artificial Sequence
  Description of Artificial Sequence:  Enzymatic Nucleic Acid
ccgtaggaggctagctacaacgagatgacaa

SEQ ID NO: 19499 - DNA, 31 bp, Artificial Sequence
  Description of Artificial Sequence:  Enzymatic Nucleic Acid
acggtccgggctagctacaacgaaggatgat

SEQ ID NO: 19500 - DNA, 31 bp, Artificial Sequence
  Description of Artificial Sequence:  Enzymatic Nucleic Acid
cttaacggggctagctacaacgaccgtagga

SEQ ID NO: 19501 - DNA, 31 bp, Artificial Sequence
  Description of Artificial Sequence:  Enzymatic Nucleic Acid
ccgcttaaggctagctacaacgaggtccgta

SEQ ID NO: 19502 - DNA, 31 bp, Artificial Sequence
  Description of Artificial Sequence:  Enzymatic Nucleic Acid
ttggcccgggctagctacaacgattaacggt

SEQ ID NO: 19503 - DNA, 31 bp, Artificial Sequence
  Description of Artificial Sequence:  Enzymatic Nucleic Acid
tccattggggctagctacaacgaccgcttaa

SEQ ID NO: 19504 - DNA, 31 bp, Artificial Sequence
  Description of Artificial Sequence:  Enzymatic Nucleic Acid
cccctccaggctagctacaacgatggcccgc

SEQ ID NO: 19505 - DNA, 31 bp, Artificial Sequence
  Description of Artificial Sequence:  Enzymatic Nucleic Acid
gtcttcagggctagctacaacgatcccctcc

SEQ ID NO: 19506 - DNA, 31 bp, Artificial Sequence
  Description of Artificial Sequence:  Enzymatic Nucleic Acid
gtagcctgggctagctacaacgacttcagtt

SEQ ID NO: 19507 - DNA, 31 bp, Artificial Sequence
  Description of Artificial Sequence:  Enzymatic Nucleic Acid
acaagtagggctagctacaacgactgtcttc

SEQ ID NO: 19508 - DNA, 31 bp, Artificial Sequence
  Description of Artificial Sequence:  Enzymatic Nucleic Acid
tggacaagggctagctacaacgaagcctgtc

SEQ ID NO: 19509 - DNA, 31 bp, Artificial Sequence
  Description of Artificial Sequence:  Enzymatic Nucleic Acid
acgatggaggctagctacaacgaaagtagcc

SEQ ID NO: 19510 - DNA, 31 bp, Artificial Sequence
  Description of Artificial Sequence:  Enzymatic Nucleic Acid
catgacgaggctagctacaacgaggacaagt

SEQ ID NO: 19511 - DNA, 31 bp, Artificial Sequence
  Description of Artificial Sequence:  Enzymatic Nucleic Acid
atccatgaggctagctacaacgagatggaca

SEQ ID NO: 19512 - DNA, 31 bp, Artificial Sequence
  Description of Artificial Sequence:  Enzymatic Nucleic Acid
tggatccaggctagctacaacgagacgatgg

SEQ ID NO: 19513 - DNA, 31 bp, Artificial Sequence
  Description of Artificial Sequence:  Enzymatic Nucleic Acid
catctggaggctagctacaacgaccatgacg

SEQ ID NO: 19514 - DNA, 31 bp, Artificial Sequence
  Description of Artificial Sequence:  Enzymatic Nucleic Acid
ggagttcaggctagctacaacgactggatcc

SEQ ID NO: 19515 - DNA, 31 bp, Artificial Sequence
  Description of Artificial Sequence:  Enzymatic Nucleic Acid
aatgggagggctagctacaacgatcatctgg

SEQ ID NO: 19516 - DNA, 31 bp, Artificial Sequence
  Description of Artificial Sequence:  Enzymatic Nucleic Acid
tcatccaaggctagctacaacgagggagttc

SEQ ID NO: 19517 - DNA, 31 bp, Artificial Sequence
  Description of Artificial Sequence:  Enzymatic Nucleic Acid
aatgttcaggctagctacaacgaccaatggg

SEQ ID NO: 19518 - DNA, 31 bp, Artificial Sequence
  Description of Artificial Sequence:  Enzymatic Nucleic Acid
tcacaatgggctagctacaacgatcatccaa

SEQ ID NO: 19519 - DNA, 31 bp, Artificial Sequence
  Description of Artificial Sequence:  Enzymatic Nucleic Acid
gttcacaaggctagctacaacgagttcatcc

SEQ ID NO: 19520 - DNA, 31 bp, Artificial Sequence
  Description of Artificial Sequence:  Enzymatic Nucleic Acid
gtcgttcaggctagctacaacgaaatgttca

SEQ ID NO: 19521 - DNA, 31 bp, Artificial Sequence
  Description of Artificial Sequence:  Enzymatic Nucleic Acid
ggcagtcgggctagctacaacgatcacaatg

SEQ ID NO: 19522 - DNA, 31 bp, Artificial Sequence
  Description of Artificial Sequence:  Enzymatic Nucleic Acid
taaggcagggctagctacaacgacgttcaca

SEQ ID NO: 19523 - DNA, 31 bp, Artificial Sequence
  Description of Artificial Sequence:  Enzymatic Nucleic Acid
tcataaggggctagctacaacgaagtcgttc

SEQ ID NO: 19524 - DNA, 31 bp, Artificial Sequence
  Description of Artificial Sequence:  Enzymatic Nucleic Acid
tggcatcaggctagctacaacgaaaggcagt

SEQ ID NO: 19525 - DNA, 31 bp, Artificial Sequence
  Description of Artificial Sequence:  Enzymatic Nucleic Acid
tgctggcaggctagctacaacgacataaggc

SEQ ID NO: 19526 - DNA, 31 bp, Artificial Sequence
  Description of Artificial Sequence:  Enzymatic Nucleic Acid
tttgctggggctagctacaacgaatcataag

SEQ ID NO: 19527 - DNA, 31 bp, Artificial Sequence
  Description of Artificial Sequence:  Enzymatic Nucleic Acid
cccatttgggctagctacaacgatggcatca

SEQ ID NO: 19528 - DNA, 31 bp, Artificial Sequence
  Description of Artificial Sequence:  Enzymatic Nucleic Acid
aattcccaggctagctacaacgattgctggc

SEQ ID NO: 19529 - DNA, 31 bp, Artificial Sequence
  Description of Artificial Sequence:  Enzymatic Nucleic Acid
ctggggaaggctagctacaacgatcccattt

SEQ ID NO: 19530 - DNA, 31 bp, Artificial Sequence
  Description of Artificial Sequence:  Enzymatic Nucleic Acid
tcagccggggctagctacaacgactctgggg

SEQ ID NO: 19531 - DNA, 31 bp, Artificial Sequence
  Description of Artificial Sequence:  Enzymatic Nucleic Acid
agcttcagggctagctacaacgacggtctct

SEQ ID NO: 19532 - DNA, 31 bp, Artificial Sequence
  Description of Artificial Sequence:  Enzymatic Nucleic Acid
ttacctagggctagctacaacgattcagccg

SEQ ID NO: 19533 - DNA, 31 bp, Artificial Sequence
  Description of Artificial Sequence:  Enzymatic Nucleic Acid
gaggcttaggctagctacaacgactagcttc

SEQ ID NO: 19534 - DNA, 31 bp, Artificial Sequence
  Description of Artificial Sequence:  Enzymatic Nucleic Acid
ccaagaggggctagctacaacgattacctag

SEQ ID NO: 19535 - DNA, 31 bp, Artificial Sequence
  Description of Artificial Sequence:  Enzymatic Nucleic Acid
caccacggggctagctacaacgacaagaggc

SEQ ID NO: 19536 - DNA, 31 bp, Artificial Sequence
  Description of Artificial Sequence:  Enzymatic Nucleic Acid
aggcaccaggctagctacaacgaggccaaga

SEQ ID NO: 19537 - DNA, 31 bp, Artificial Sequence
  Description of Artificial Sequence:  Enzymatic Nucleic Acid
caaaggcaggctagctacaacgacacggcca

SEQ ID NO: 19538 - DNA, 31 bp, Artificial Sequence
  Description of Artificial Sequence:  Enzymatic Nucleic Acid
gccaaaggggctagctacaacgaaccacggc

SEQ ID NO: 19539 - DNA, 31 bp, Artificial Sequence
  Description of Artificial Sequence:  Enzymatic Nucleic Acid
tcacttggggctagctacaacgacaaaggca

SEQ ID NO: 19540 - DNA, 31 bp, Artificial Sequence
  Description of Artificial Sequence:  Enzymatic Nucleic Acid
ttcaatcaggctagctacaacgattggccaa

SEQ ID NO: 19541 - DNA, 31 bp, Artificial Sequence
  Description of Artificial Sequence:  Enzymatic Nucleic Acid
tgcttcaaggctagctacaacgacacttggc

SEQ ID NO: 19542 - DNA, 31 bp, Artificial Sequence
  Description of Artificial Sequence:  Enzymatic Nucleic Acid
ggcatctgggctagctacaacgattcaatca

SEQ ID NO: 19543 - DNA, 31 bp, Artificial Sequence
  Description of Artificial Sequence:  Enzymatic Nucleic Acid
caaaggcaggctagctacaacgactgcttca

SEQ ID NO: 19544 - DNA, 31 bp, Artificial Sequence
  Description of Artificial Sequence:  Enzymatic Nucleic Acid
tccaaaggggctagctacaacgaatctgctt

SEQ ID NO: 19545 - DNA, 31 bp, Artificial Sequence
  Description of Artificial Sequence:  Enzymatic Nucleic Acid
cttgtcaaggctagctacaacgatccaaagg

SEQ ID NO: 19546 - DNA, 31 bp, Artificial Sequence
  Description of Artificial Sequence:  Enzymatic Nucleic Acid
ctgtcttgggctagctacaacgacaattcca

SEQ ID NO: 19547 - DNA, 31 bp, Artificial Sequence
  Description of Artificial Sequence:  Enzymatic Nucleic Acid
agttgctgggctagctacaacgacttgtcaa

SEQ ID NO: 19548 - DNA, 31 bp, Artificial Sequence
  Description of Artificial Sequence:  Enzymatic Nucleic Acid
gcaagttgggctagctacaacgatgtcttgt

SEQ ID NO: 19549 - DNA, 31 bp, Artificial Sequence
  Description of Artificial Sequence:  Enzymatic Nucleic Acid
cctgcaagggctagctacaacgatgctgtct

SEQ ID NO: 19550 - DNA, 31 bp, Artificial Sequence
  Description of Artificial Sequence:  Enzymatic Nucleic Acid
ctgtcctgggctagctacaacgaaagttgct

SEQ ID NO: 19551 - DNA, 31 bp, Artificial Sequence
  Description of Artificial Sequence:  Enzymatic Nucleic Acid
tgctactgggctagctacaacgacctgcaag

SEQ ID NO: 19552 - DNA, 31 bp, Artificial Sequence
  Description of Artificial Sequence:  Enzymatic Nucleic Acid
gactgctaggctagctacaacgatgtcctgc

SEQ ID NO: 19553 - DNA, 31 bp, Artificial Sequence
  Description of Artificial Sequence:  Enzymatic Nucleic Acid
tttgactgggctagctacaacgatactgtcc

SEQ ID NO: 19554 - DNA, 31 bp, Artificial Sequence
  Description of Artificial Sequence:  Enzymatic Nucleic Acid
cattttgaggctagctacaacgatgctactg

SEQ ID NO: 19555 - DNA, 31 bp, Artificial Sequence
  Description of Artificial Sequence:  Enzymatic Nucleic Acid
tttcaacaggctagctacaacgatttgactg

SEQ ID NO: 19556 - DNA, 31 bp, Artificial Sequence
  Description of Artificial Sequence:  Enzymatic Nucleic Acid
tctttcaaggctagctacaacgaattttgac

SEQ ID NO: 19557 - DNA, 31 bp, Artificial Sequence
  Description of Artificial Sequence:  Enzymatic Nucleic Acid
gtgtgttgggctagctacaacgatccttctt

SEQ ID NO: 19558 - DNA, 31 bp, Artificial Sequence
  Description of Artificial Sequence:  Enzymatic Nucleic Acid
actgtgtgggctagctacaacgatgctcctt

SEQ ID NO: 19559 - DNA, 31 bp, Artificial Sequence
  Description of Artificial Sequence:  Enzymatic Nucleic Acid
tcactgtgggctagctacaacgagttgctcc

SEQ ID NO: 19560 - DNA, 31 bp, Artificial Sequence
  Description of Artificial Sequence:  Enzymatic Nucleic Acid
gctcactgggctagctacaacgagtgttgct

SEQ ID NO: 19561 - DNA, 31 bp, Artificial Sequence
  Description of Artificial Sequence:  Enzymatic Nucleic Acid
gatgctcaggctagctacaacgatgtgtgtt

SEQ ID NO: 19562 - DNA, 31 bp, Artificial Sequence
  Description of Artificial Sequence:  Enzymatic Nucleic Acid
gctcgatgggctagctacaacgatcactgtg

SEQ ID NO: 19563 - DNA, 31 bp, Artificial Sequence
  Description of Artificial Sequence:  Enzymatic Nucleic Acid
gagctcgaggctagctacaacgagctcactg

SEQ ID NO: 19564 - DNA, 31 bp, Artificial Sequence
  Description of Artificial Sequence:  Enzymatic Nucleic Acid
catgagagggctagctacaacgatcgatgct

SEQ ID NO: 19565 - DNA, 31 bp, Artificial Sequence
  Description of Artificial Sequence:  Enzymatic Nucleic Acid
ttcagacaggctagctacaacgagagagctc

SEQ ID NO: 19566 - DNA, 31 bp, Artificial Sequence
  Description of Artificial Sequence:  Enzymatic Nucleic Acid
agttcagaggctagctacaacgaatgagagc

SEQ ID NO: 19567 - DNA, 31 bp, Artificial Sequence
  Description of Artificial Sequence:  Enzymatic Nucleic Acid
atcttgagggctagctacaacgatcagacat

SEQ ID NO: 19568 - DNA, 31 bp, Artificial Sequence
  Description of Artificial Sequence:  Enzymatic Nucleic Acid
aatgaggaggctagctacaacgacttgagtt

SEQ ID NO: 19569 - DNA, 31 bp, Artificial Sequence
  Description of Artificial Sequence:  Enzymatic Nucleic Acid
aatatgaaggctagctacaacgagaggatct

SEQ ID NO: 19570 - DNA, 31 bp, Artificial Sequence
  Description of Artificial Sequence:  Enzymatic Nucleic Acid
gaccaataggctagctacaacgagaatgagg

SEQ ID NO: 19571 - DNA, 31 bp, Artificial Sequence
  Description of Artificial Sequence:  Enzymatic Nucleic Acid
gtgaccaaggctagctacaacgaatgaatga

SEQ ID NO: 19572 - DNA, 31 bp, Artificial Sequence
  Description of Artificial Sequence:  Enzymatic Nucleic Acid
gatggtgaggctagctacaacgacaatatga

SEQ ID NO: 19573 - DNA, 31 bp, Artificial Sequence
  Description of Artificial Sequence:  Enzymatic Nucleic Acid
tgagatggggctagctacaacgagaccaata

SEQ ID NO: 19574 - DNA, 31 bp, Artificial Sequence
  Description of Artificial Sequence:  Enzymatic Nucleic Acid
cattgagaggctagctacaacgaggtgacca

SEQ ID NO: 19575 - DNA, 31 bp, Artificial Sequence
  Description of Artificial Sequence:  Enzymatic Nucleic Acid
tgaccacaggctagctacaacgatgagatgg

SEQ ID NO: 19576 - DNA, 31 bp, Artificial Sequence
  Description of Artificial Sequence:  Enzymatic Nucleic Acid
gttgaccaggctagctacaacgaattgagat

SEQ ID NO: 19577 - DNA, 31 bp, Artificial Sequence
  Description of Artificial Sequence:  Enzymatic Nucleic Acid
aaggttgaggctagctacaacgacacattga

SEQ ID NO: 19578 - DNA, 31 bp, Artificial Sequence
  Description of Artificial Sequence:  Enzymatic Nucleic Acid
ctagaaggggctagctacaacgatgaccaca

SEQ ID NO: 19579 - DNA, 31 bp, Artificial Sequence
  Description of Artificial Sequence:  Enzymatic Nucleic Acid
tacaggcaggctagctacaacgactagaagg

SEQ ID NO: 19580 - DNA, 31 bp, Artificial Sequence
  Description of Artificial Sequence:  Enzymatic Nucleic Acid
ggtacaggggctagctacaacgaacctagaa

SEQ ID NO: 19581 - DNA, 31 bp, Artificial Sequence
  Description of Artificial Sequence:  Enzymatic Nucleic Acid
gcttggtaggctagctacaacgaaggcacct

SEQ ID NO: 19582 - DNA, 31 bp, Artificial Sequence
  Description of Artificial Sequence:  Enzymatic Nucleic Acid
tggcttggggctagctacaacgaacaggcac

SEQ ID NO: 19583 - DNA, 31 bp, Artificial Sequence
  Description of Artificial Sequence:  Enzymatic Nucleic Acid
cctcctggggctagctacaacgattggtaca

SEQ ID NO: 19584 - DNA, 31 bp, Artificial Sequence
  Description of Artificial Sequence:  Enzymatic Nucleic Acid
atgagtggggctagctacaacgacctcctgg

SEQ ID NO: 19585 - DNA, 31 bp, Artificial Sequence
  Description of Artificial Sequence:  Enzymatic Nucleic Acid
accatgagggctagctacaacgaggccctcc

SEQ ID NO: 19586 - DNA, 31 bp, Artificial Sequence
  Description of Artificial Sequence:  Enzymatic Nucleic Acid
aatcaccaggctagctacaacgagagtggcc

SEQ ID NO: 19587 - DNA, 31 bp, Artificial Sequence
  Description of Artificial Sequence:  Enzymatic Nucleic Acid
cacaatcaggctagctacaacgacatgagtg

SEQ ID NO: 19588 - DNA, 31 bp, Artificial Sequence
  Description of Artificial Sequence:  Enzymatic Nucleic Acid
ttccacaaggctagctacaacgacaccatga

SEQ ID NO: 19589 - DNA, 31 bp, Artificial Sequence
  Description of Artificial Sequence:  Enzymatic Nucleic Acid
gaattccaggctagctacaacgaaatcacca

SEQ ID NO: 19590 - DNA, 31 bp, Artificial Sequence
  Description of Artificial Sequence:  Enzymatic Nucleic Acid
ttgcagaaggctagctacaacgatccacaat

SEQ ID NO: 19591 - DNA, 31 bp, Artificial Sequence
  Description of Artificial Sequence:  Enzymatic Nucleic Acid
caaatttgggctagctacaacgaagaattcc

SEQ ID NO: 19592 - DNA, 31 bp, Artificial Sequence
  Description of Artificial Sequence:  Enzymatic Nucleic Acid
tttccaaaggctagctacaacgattgcagaa

SEQ ID NO: 19593 - DNA, 31 bp, Artificial Sequence
  Description of Artificial Sequence:  Enzymatic Nucleic Acid
tggacaggggctagctacaacgattccaaat

SEQ ID NO: 19594 - DNA, 31 bp, Artificial Sequence
  Description of Artificial Sequence:  Enzymatic Nucleic Acid
taagtggaggctagctacaacgaaggtttcc

SEQ ID NO: 19595 - DNA, 31 bp, Artificial Sequence
  Description of Artificial Sequence:  Enzymatic Nucleic Acid
caggtaagggctagctacaacgaggacaggt

SEQ ID NO: 19596 - DNA, 31 bp, Artificial Sequence
  Description of Artificial Sequence:  Enzymatic Nucleic Acid
tcctcaggggctagctacaacgaaagtggac

SEQ ID NO: 19597 - DNA, 31 bp, Artificial Sequence
  Description of Artificial Sequence:  Enzymatic Nucleic Acid
ttctcttgggctagctacaacgatcctcagg

SEQ ID NO: 19598 - DNA, 31 bp, Artificial Sequence
  Description of Artificial Sequence:  Enzymatic Nucleic Acid
caaattcaggctagctacaacgattctcttg

SEQ ID NO: 19599 - DNA, 31 bp, Artificial Sequence
  Description of Artificial Sequence:  Enzymatic Nucleic Acid
gggacaaaggctagctacaacgatcatttct

SEQ ID NO: 19600 - DNA, 31 bp, Artificial Sequence
  Description of Artificial Sequence:  Enzymatic Nucleic Acid
gtaggggaggctagctacaacgaaaattcat

SEQ ID NO: 19601 - DNA, 31 bp, Artificial Sequence
  Description of Artificial Sequence:  Enzymatic Nucleic Acid
tggtcttgggctagctacaacgaaggggaca

SEQ ID NO: 19602 - DNA, 31 bp, Artificial Sequence
  Description of Artificial Sequence:  Enzymatic Nucleic Acid
ccctttggggctagctacaacgacttgtagg

SEQ ID NO: 19603 - DNA, 31 bp, Artificial Sequence
  Description of Artificial Sequence:  Enzymatic Nucleic Acid
gaatcgtgggctagctacaacgaccctttgg

SEQ ID NO: 19604 - DNA, 31 bp, Artificial Sequence
  Description of Artificial Sequence:  Enzymatic Nucleic Acid
cggaatcgggctagctacaacgagccccttt

SEQ ID NO: 19605 - DNA, 31 bp, Artificial Sequence
  Description of Artificial Sequence:  Enzymatic Nucleic Acid
tgacggaaggctagctacaacgacgtgcccc

SEQ ID NO: 19606 - DNA, 31 bp, Artificial Sequence
  Description of Artificial Sequence:  Enzymatic Nucleic Acid
tcccttgaggctagctacaacgaggaatcgt

SEQ ID NO: 19607 - DNA, 31 bp, Artificial Sequence
  Description of Artificial Sequence:  Enzymatic Nucleic Acid
caacgtagggctagctacaacgactttccct

SEQ ID NO: 19608 - DNA, 31 bp, Artificial Sequence
  Description of Artificial Sequence:  Enzymatic Nucleic Acid
ctccaacgggctagctacaacgaagtctttc

SEQ ID NO: 19609 - DNA, 31 bp, Artificial Sequence
  Description of Artificial Sequence:  Enzymatic Nucleic Acid
tgctccaaggctagctacaacgagtagtctt

SEQ ID NO: 19610 - DNA, 31 bp, Artificial Sequence
  Description of Artificial Sequence:  Enzymatic Nucleic Acid
agggattgggctagctacaacgatccaacgt

SEQ ID NO: 19611 - DNA, 31 bp, Artificial Sequence
  Description of Artificial Sequence:  Enzymatic Nucleic Acid
cacagggaggctagctacaacgatgctccaa

SEQ ID NO: 19612 - DNA, 31 bp, Artificial Sequence
  Description of Artificial Sequence:  Enzymatic Nucleic Acid
cagatccaggctagctacaacgaagggattg

SEQ ID NO: 19613 - DNA, 31 bp, Artificial Sequence
  Description of Artificial Sequence:  Enzymatic Nucleic Acid
gtttcagaggctagctacaacgaccacaggg

SEQ ID NO: 19614 - DNA, 31 bp, Artificial Sequence
  Description of Artificial Sequence:  Enzymatic Nucleic Acid
aagcgccgggctagctacaacgattcagatc

SEQ ID NO: 19615 - DNA, 31 bp, Artificial Sequence
  Description of Artificial Sequence:  Enzymatic Nucleic Acid
tccaagcgggctagctacaacgacgtttcag

SEQ ID NO: 19616 - DNA, 31 bp, Artificial Sequence
  Description of Artificial Sequence:  Enzymatic Nucleic Acid
tgtccaagggctagctacaacgagccgtttc

SEQ ID NO: 19617 - DNA, 31 bp, Artificial Sequence
  Description of Artificial Sequence:  Enzymatic Nucleic Acid
tgatgctgggctagctacaacgaccaagcgc

SEQ ID NO: 19618 - DNA, 31 bp, Artificial Sequence
  Description of Artificial Sequence:  Enzymatic Nucleic Acid
tggtgatgggctagctacaacgatgtccaag

SEQ ID NO: 19619 - DNA, 31 bp, Artificial Sequence
  Description of Artificial Sequence:  Enzymatic Nucleic Acid
actggtgaggctagctacaacgagctgtcca

SEQ ID NO: 19620 - DNA, 31 bp, Artificial Sequence
  Description of Artificial Sequence:  Enzymatic Nucleic Acid
gctactggggctagctacaacgagatgctgt

SEQ ID NO: 19621 - DNA, 31 bp, Artificial Sequence
  Description of Artificial Sequence:  Enzymatic Nucleic Acid
tctggctaggctagctacaacgatggtgatg

SEQ ID NO: 19622 - DNA, 31 bp, Artificial Sequence
  Description of Artificial Sequence:  Enzymatic Nucleic Acid
agctctggggctagctacaacgatactggtg

SEQ ID NO: 19623 - DNA, 31 bp, Artificial Sequence
  Description of Artificial Sequence:  Enzymatic Nucleic Acid
tggctgagggctagctacaacgatctggcta

SEQ ID NO: 19624 - DNA, 31 bp, Artificial Sequence
  Description of Artificial Sequence:  Enzymatic Nucleic Acid
agagctggggctagctacaacgatgagctct

SEQ ID NO: 19625 - DNA, 31 bp, Artificial Sequence
  Description of Artificial Sequence:  Enzymatic Nucleic Acid
atccagagggctagctacaacgatggctgag

SEQ ID NO: 19626 - DNA, 31 bp, Artificial Sequence
  Description of Artificial Sequence:  Enzymatic Nucleic Acid
tccacaaaggctagctacaacgaccagagct

SEQ ID NO: 19627 - DNA, 31 bp, Artificial Sequence
  Description of Artificial Sequence:  Enzymatic Nucleic Acid
ctcctccaggctagctacaacgaaaatccag

SEQ ID NO: 19628 - DNA, 31 bp, Artificial Sequence
  Description of Artificial Sequence:  Enzymatic Nucleic Acid
ctgagggaggctagctacaacgattctcctc

SEQ ID NO: 19629 - DNA, 31 bp, Artificial Sequence
  Description of Artificial Sequence:  Enzymatic Nucleic Acid
ctacatcaggctagctacaacgatgagggac

SEQ ID NO: 19630 - DNA, 31 bp, Artificial Sequence
  Description of Artificial Sequence:  Enzymatic Nucleic Acid
cttctacaggctagctacaacgacactgagg

SEQ ID NO: 19631 - DNA, 31 bp, Artificial Sequence
  Description of Artificial Sequence:  Enzymatic Nucleic Acid
ttcttctaggctagctacaacgaatcactga

SEQ ID NO: 19632 - DNA, 31 bp, Artificial Sequence
  Description of Artificial Sequence:  Enzymatic Nucleic Acid
ttcaggagggctagctacaacgattcctctt

SEQ ID NO: 19633 - DNA, 31 bp, Artificial Sequence
  Description of Artificial Sequence:  Enzymatic Nucleic Acid
tatacagaggctagctacaacgacttcagga

SEQ ID NO: 19634 - DNA, 31 bp, Artificial Sequence
  Description of Artificial Sequence:  Enzymatic Nucleic Acid
tccttataggctagctacaacgaagatcttc

SEQ ID NO: 19635 - DNA, 31 bp, Artificial Sequence
  Description of Artificial Sequence:  Enzymatic Nucleic Acid
agtccttaggctagctacaacgaacagatct

SEQ ID NO: 19636 - DNA, 31 bp, Artificial Sequence
  Description of Artificial Sequence:  Enzymatic Nucleic Acid
tcaggaagggctagctacaacgaccttatac

SEQ ID NO: 19637 - DNA, 31 bp, Artificial Sequence
  Description of Artificial Sequence:  Enzymatic Nucleic Acid
ctccaaggggctagctacaacgacaggaagt

SEQ ID NO: 19638 - DNA, 31 bp, Artificial Sequence
  Description of Artificial Sequence:  Enzymatic Nucleic Acid
atgagatgggctagctacaacgatccaaggt

SEQ ID NO: 19639 - DNA, 31 bp, Artificial Sequence
  Description of Artificial Sequence:  Enzymatic Nucleic Acid
agatgagaggctagctacaacgagctccaag

SEQ ID NO: 19640 - DNA, 31 bp, Artificial Sequence
  Description of Artificial Sequence:  Enzymatic Nucleic Acid
gtaacagaggctagctacaacgagagatgct

SEQ ID NO: 19641 - DNA, 31 bp, Artificial Sequence
  Description of Artificial Sequence:  Enzymatic Nucleic Acid
agctgtaaggctagctacaacgaagatgaga

SEQ ID NO: 19642 - DNA, 31 bp, Artificial Sequence
  Description of Artificial Sequence:  Enzymatic Nucleic Acid
ggaagctgggctagctacaacgaaacagatg

SEQ ID NO: 19643 - DNA, 31 bp, Artificial Sequence
  Description of Artificial Sequence:  Enzymatic Nucleic Acid
cttggaagggctagctacaacgatgtaacag

SEQ ID NO: 19644 - DNA, 31 bp, Artificial Sequence
  Description of Artificial Sequence:  Enzymatic Nucleic Acid
cttagccaggctagctacaacgattggaagc

SEQ ID NO: 19645 - DNA, 31 bp, Artificial Sequence
  Description of Artificial Sequence:  Enzymatic Nucleic Acid
gcccttagggctagctacaacgacacttgga

SEQ ID NO: 19646 - DNA, 31 bp, Artificial Sequence
  Description of Artificial Sequence:  Enzymatic Nucleic Acid
actccatgggctagctacaacgaccttagcc

SEQ ID NO: 19647 - DNA, 31 bp, Artificial Sequence
  Description of Artificial Sequence:  Enzymatic Nucleic Acid
gaactccaggctagctacaacgagcccttag

SEQ ID NO: 19648 - DNA, 31 bp, Artificial Sequence
  Description of Artificial Sequence:  Enzymatic Nucleic Acid
gccaagaaggctagctacaacgatccatgcc

SEQ ID NO: 19649 - DNA, 31 bp, Artificial Sequence
  Description of Artificial Sequence:  Enzymatic Nucleic Acid
tcgcgatgggctagctacaacgacaagaact

SEQ ID NO: 19650 - DNA, 31 bp, Artificial Sequence
  Description of Artificial Sequence:  Enzymatic Nucleic Acid
tttcgcgaggctagctacaacgagccaagaa

SEQ ID NO: 19651 - DNA, 31 bp, Artificial Sequence
  Description of Artificial Sequence:  Enzymatic Nucleic Acid
cactttcgggctagctacaacgagatgccaa

SEQ ID NO: 19652 - DNA, 31 bp, Artificial Sequence
  Description of Artificial Sequence:  Enzymatic Nucleic Acid
tggatacaggctagctacaacgatttcgcga

SEQ ID NO: 19653 - DNA, 31 bp, Artificial Sequence
  Description of Artificial Sequence:  Enzymatic Nucleic Acid
tgtggataggctagctacaacgaactttcgc

SEQ ID NO: 19654 - DNA, 31 bp, Artificial Sequence
  Description of Artificial Sequence:  Enzymatic Nucleic Acid
cctgtggaggctagctacaacgaacactttc

SEQ ID NO: 19655 - DNA, 31 bp, Artificial Sequence
  Description of Artificial Sequence:  Enzymatic Nucleic Acid
ggtccctgggctagctacaacgaggatacac

SEQ ID NO: 19656 - DNA, 31 bp, Artificial Sequence
  Description of Artificial Sequence:  Enzymatic Nucleic Acid
ccgccaggggctagctacaacgaccctgtgg

SEQ ID NO: 19657 - DNA, 31 bp, Artificial Sequence
  Description of Artificial Sequence:  Enzymatic Nucleic Acid
tcgtgccgggctagctacaacgacaggtccc

SEQ ID NO: 19658 - DNA, 31 bp, Artificial Sequence
  Description of Artificial Sequence:  Enzymatic Nucleic Acid
atttcgtgggctagctacaacgacgccaggt

SEQ ID NO: 19659 - DNA, 31 bp, Artificial Sequence
  Description of Artificial Sequence:  Enzymatic Nucleic Acid
atatttcgggctagctacaacgagccgccag

SEQ ID NO: 19660 - DNA, 31 bp, Artificial Sequence
  Description of Artificial Sequence:  Enzymatic Nucleic Acid
agaggataggctagctacaacgattcgtgcc

SEQ ID NO: 19661 - DNA, 31 bp, Artificial Sequence
  Description of Artificial Sequence:  Enzymatic Nucleic Acid
taagaggaggctagctacaacgaatttcgtg

SEQ ID NO: 19662 - DNA, 31 bp, Artificial Sequence
  Description of Artificial Sequence:  Enzymatic Nucleic Acid
ttctccgaggctagctacaacgaaagaggat

SEQ ID NO: 19663 - DNA, 31 bp, Artificial Sequence
  Description of Artificial Sequence:  Enzymatic Nucleic Acid
taaccacgggctagctacaacgatcttctcc

SEQ ID NO: 19664 - DNA, 31 bp, Artificial Sequence
  Description of Artificial Sequence:  Enzymatic Nucleic Acid
tttaaccaggctagctacaacgagttcttct

SEQ ID NO: 19665 - DNA, 31 bp, Artificial Sequence
  Description of Artificial Sequence:  Enzymatic Nucleic Acid
gattttaaggctagctacaacgacacgttct

SEQ ID NO: 19666 - DNA, 31 bp, Artificial Sequence
  Description of Artificial Sequence:  Enzymatic Nucleic Acid
gtcacagaggctagctacaacgatttaacca

SEQ ID NO: 19667 - DNA, 31 bp, Artificial Sequence
  Description of Artificial Sequence:  Enzymatic Nucleic Acid
caaagtcaggctagctacaacgaagatttta

SEQ ID NO: 19668 - DNA, 31 bp, Artificial Sequence
  Description of Artificial Sequence:  Enzymatic Nucleic Acid
agccaaagggctagctacaacgacacagatt

SEQ ID NO: 19669 - DNA, 31 bp, Artificial Sequence
  Description of Artificial Sequence:  Enzymatic Nucleic Acid
gggccaagggctagctacaacgacaaagtca

SEQ ID NO: 19670 - DNA, 31 bp, Artificial Sequence
  Description of Artificial Sequence:  Enzymatic Nucleic Acid
atcccgggggctagctacaacgacaagccaa

SEQ ID NO: 19671 - DNA, 31 bp, Artificial Sequence
  Description of Artificial Sequence:  Enzymatic Nucleic Acid
tataaataggctagctacaacgacccgggcc

SEQ ID NO: 19672 - DNA, 31 bp, Artificial Sequence
  Description of Artificial Sequence:  Enzymatic Nucleic Acid
tttataaaggctagctacaacgaatcccggg

SEQ ID NO: 19673 - DNA, 31 bp, Artificial Sequence
  Description of Artificial Sequence:  Enzymatic Nucleic Acid
gatctttaggctagctacaacgaaaatatcc

SEQ ID NO: 19674 - DNA, 31 bp, Artificial Sequence
  Description of Artificial Sequence:  Enzymatic Nucleic Acid
aatctggaggctagctacaacgactttataa

SEQ ID NO: 19675 - DNA, 31 bp, Artificial Sequence
  Description of Artificial Sequence:  Enzymatic Nucleic Acid
tgacataaggctagctacaacgactggatct

SEQ ID NO: 19676 - DNA, 31 bp, Artificial Sequence
  Description of Artificial Sequence:  Enzymatic Nucleic Acid
ttctgacaggctagctacaacgaaatctgga

SEQ ID NO: 19677 - DNA, 31 bp, Artificial Sequence
  Description of Artificial Sequence:  Enzymatic Nucleic Acid
ttttctgaggctagctacaacgaataatctg

SEQ ID NO: 19678 - DNA, 31 bp, Artificial Sequence
  Description of Artificial Sequence:  Enzymatic Nucleic Acid
ggcgagcaggctagctacaacgactcctttt

SEQ ID NO: 19679 - DNA, 31 bp, Artificial Sequence
  Description of Artificial Sequence:  Enzymatic Nucleic Acid
gaggcgagggctagctacaacgaatctcctt

SEQ ID NO: 19680 - DNA, 31 bp, Artificial Sequence
  Description of Artificial Sequence:  Enzymatic Nucleic Acid
aagggaggggctagctacaacgagagcatct

SEQ ID NO: 19681 - DNA, 31 bp, Artificial Sequence
  Description of Artificial Sequence:  Enzymatic Nucleic Acid
gccatccaggctagctacaacgattcaaagg

SEQ ID NO: 19682 - DNA, 31 bp, Artificial Sequence
  Description of Artificial Sequence:  Enzymatic Nucleic Acid
tggggccaggctagctacaacgaccatttca

SEQ ID NO: 19683 - DNA, 31 bp, Artificial Sequence
  Description of Artificial Sequence:  Enzymatic Nucleic Acid
ttctggggggctagctacaacgacatccatt

SEQ ID NO: 19684 - DNA, 31 bp, Artificial Sequence
  Description of Artificial Sequence:  Enzymatic Nucleic Acid
aaaaattgggctagctacaacgattctgggg

SEQ ID NO: 19685 - DNA, 31 bp, Artificial Sequence
  Description of Artificial Sequence:  Enzymatic Nucleic Acid
gtcaaaaaggctagctacaacgatgtttctg

SEQ ID NO: 19686 - DNA, 31 bp, Artificial Sequence
  Description of Artificial Sequence:  Enzymatic Nucleic Acid
acactctgggctagctacaacgacaaaaatt

SEQ ID NO: 19687 - DNA, 31 bp, Artificial Sequence
  Description of Artificial Sequence:  Enzymatic Nucleic Acid
tgtgtacaggctagctacaacgatctgtcaa

SEQ ID NO: 19688 - DNA, 31 bp, Artificial Sequence
  Description of Artificial Sequence:  Enzymatic Nucleic Acid
attgtgtaggctagctacaacgaactctgtc

SEQ ID NO: 19689 - DNA, 31 bp, Artificial Sequence
  Description of Artificial Sequence:  Enzymatic Nucleic Acid
ggattgtgggctagctacaacgaacactctg

SEQ ID NO: 19690 - DNA, 31 bp, Artificial Sequence
  Description of Artificial Sequence:  Enzymatic Nucleic Acid
ctggattgggctagctacaacgagtacactc

SEQ ID NO: 19691 - DNA, 31 bp, Artificial Sequence
  Description of Artificial Sequence:  Enzymatic Nucleic Acid
actctggaggctagctacaacgatgtgtaca

SEQ ID NO: 19692 - DNA, 31 bp, Artificial Sequence
  Description of Artificial Sequence:  Enzymatic Nucleic Acid
agacgtcaggctagctacaacgatctggatt

SEQ ID NO: 19693 - DNA, 31 bp, Artificial Sequence
  Description of Artificial Sequence:  Enzymatic Nucleic Acid
accagacgggctagctacaacgacactctgg

SEQ ID NO: 19694 - DNA, 31 bp, Artificial Sequence
  Description of Artificial Sequence:  Enzymatic Nucleic Acid
agaccagaggctagctacaacgagtcactct

SEQ ID NO: 19695 - DNA, 31 bp, Artificial Sequence
  Description of Artificial Sequence:  Enzymatic Nucleic Acid
ccaaaagaggctagctacaacgacagacgtc

SEQ ID NO: 19696 - DNA, 31 bp, Artificial Sequence
  Description of Artificial Sequence:  Enzymatic Nucleic Acid
gcaaaacaggctagctacaacgacaaaagac

SEQ ID NO: 19697 - DNA, 31 bp, Artificial Sequence
  Description of Artificial Sequence:  Enzymatic Nucleic Acid
cagcaaaaggctagctacaacgaaccaaaag

SEQ ID NO: 19698 - DNA, 31 bp, Artificial Sequence
  Description of Artificial Sequence:  Enzymatic Nucleic Acid
tcccacagggctagctacaacgaaaaacacc

SEQ ID NO: 19699 - DNA, 31 bp, Artificial Sequence
  Description of Artificial Sequence:  Enzymatic Nucleic Acid
atttcccaggctagctacaacgaagcaaaac

SEQ ID NO: 19700 - DNA, 31 bp, Artificial Sequence
  Description of Artificial Sequence:  Enzymatic Nucleic Acid
ggaaaataggctagctacaacgattcccaca

SEQ ID NO: 19701 - DNA, 31 bp, Artificial Sequence
  Description of Artificial Sequence:  Enzymatic Nucleic Acid
aaggaaaaggctagctacaacgaatttccca

SEQ ID NO: 19702 - DNA, 31 bp, Artificial Sequence
  Description of Artificial Sequence:  Enzymatic Nucleic Acid
gagaagcaggctagctacaacgactaaggaa

SEQ ID NO: 19703 - DNA, 31 bp, Artificial Sequence
  Description of Artificial Sequence:  Enzymatic Nucleic Acid
tggagaagggctagctacaacgaacctaagg

SEQ ID NO: 19704 - DNA, 31 bp, Artificial Sequence
  Description of Artificial Sequence:  Enzymatic Nucleic Acid
ccaggataggctagctacaacgaggagaagc

SEQ ID NO: 19705 - DNA, 31 bp, Artificial Sequence
  Description of Artificial Sequence:  Enzymatic Nucleic Acid
ccccaggaggctagctacaacgaatggagaa

SEQ ID NO: 19706 - DNA, 31 bp, Artificial Sequence
  Description of Artificial Sequence:  Enzymatic Nucleic Acid
aatctttaggctagctacaacgacccaggat

SEQ ID NO: 19707 - DNA, 31 bp, Artificial Sequence
  Description of Artificial Sequence:  Enzymatic Nucleic Acid
ttcatcaaggctagctacaacgactttaccc

SEQ ID NO: 19708 - DNA, 31 bp, Artificial Sequence
  Description of Artificial Sequence:  Enzymatic Nucleic Acid
attcttcaggctagctacaacgacaatcttt

SEQ ID NO: 19709 - DNA, 31 bp, Artificial Sequence
  Description of Artificial Sequence:  Enzymatic Nucleic Acid
ctacaaaaggctagctacaacgatcttcatc

SEQ ID NO: 19710 - DNA, 31 bp, Artificial Sequence
  Description of Artificial Sequence:  Enzymatic Nucleic Acid
atcgcctaggctagctacaacgaaaaattct

SEQ ID NO: 19711 - DNA, 31 bp, Artificial Sequence
  Description of Artificial Sequence:  Enzymatic Nucleic Acid
ttcaatcgggctagctacaacgactacaaaa

SEQ ID NO: 19712 - DNA, 31 bp, Artificial Sequence
  Description of Artificial Sequence:  Enzymatic Nucleic Acid
tctttcaaggctagctacaacgacgcctaca

SEQ ID NO: 19713 - DNA, 31 bp, Artificial Sequence
  Description of Artificial Sequence:  Enzymatic Nucleic Acid
cattctagggctagctacaacgatccttctt

SEQ ID NO: 19714 - DNA, 31 bp, Artificial Sequence
  Description of Artificial Sequence:  Enzymatic Nucleic Acid
ggccctcaggctagctacaacgatctagttc

SEQ ID NO: 19715 - DNA, 31 bp, Artificial Sequence
  Description of Artificial Sequence:  Enzymatic Nucleic Acid
atcaggggggctagctacaacgacctcattc

SEQ ID NO: 19716 - DNA, 31 bp, Artificial Sequence
  Description of Artificial Sequence:  Enzymatic Nucleic Acid
tagtataaggctagctacaacgacaggggcc

SEQ ID NO: 19717 - DNA, 31 bp, Artificial Sequence
  Description of Artificial Sequence:  Enzymatic Nucleic Acid
gtgtagtaggctagctacaacgaaatcaggg

SEQ ID NO: 19718 - DNA, 31 bp, Artificial Sequence
  Description of Artificial Sequence:  Enzymatic Nucleic Acid
tggtgtagggctagctacaacgaataatcag

SEQ ID NO: 19719 - DNA, 31 bp, Artificial Sequence
  Description of Artificial Sequence:  Enzymatic Nucleic Acid
ttctggtgggctagctacaacgaagtataat

SEQ ID NO: 19720 - DNA, 31 bp, Artificial Sequence
  Description of Artificial Sequence:  Enzymatic Nucleic Acid
atttctggggctagctacaacgagtagtata

SEQ ID NO: 19721 - DNA, 31 bp, Artificial Sequence
  Description of Artificial Sequence:  Enzymatic Nucleic Acid
ctggtacaggctagctacaacgattctggtg

SEQ ID NO: 19722 - DNA, 31 bp, Artificial Sequence
  Description of Artificial Sequence:  Enzymatic Nucleic Acid
gtctggtaggctagctacaacgaatttctgg

SEQ ID NO: 19723 - DNA, 31 bp, Artificial Sequence
  Description of Artificial Sequence:  Enzymatic Nucleic Acid
tggtctggggctagctacaacgaacatttct

SEQ ID NO: 19724 - DNA, 31 bp, Artificial Sequence
  Description of Artificial Sequence:  Enzymatic Nucleic Acid
cagcatggggctagctacaacgactggtaca

SEQ ID NO: 19725 - DNA, 31 bp, Artificial Sequence
  Description of Artificial Sequence:  Enzymatic Nucleic Acid
gtccagcaggctagctacaacgaggtctggt

SEQ ID NO: 19726 - DNA, 31 bp, Artificial Sequence
  Description of Artificial Sequence:  Enzymatic Nucleic Acid
cagtccagggctagctacaacgaatggtctg

SEQ ID NO: 19727 - DNA, 31 bp, Artificial Sequence
  Description of Artificial Sequence:  Enzymatic Nucleic Acid
cgtgccagggctagctacaacgaagtccagc

SEQ ID NO: 19728 - DNA, 31 bp, Artificial Sequence
  Description of Artificial Sequence:  Enzymatic Nucleic Acid
tccccgtgggctagctacaacgacagcagtc

SEQ ID NO: 19729 - DNA, 31 bp, Artificial Sequence
  Description of Artificial Sequence:  Enzymatic Nucleic Acid
gctccccgggctagctacaacgagccagcag

SEQ ID NO: 19730 - DNA, 31 bp, Artificial Sequence
  Description of Artificial Sequence:  Enzymatic Nucleic Acid
tgactgggggctagctacaacgatccccgtg

SEQ ID NO: 19731 - DNA, 31 bp, Artificial Sequence
  Description of Artificial Sequence:  Enzymatic Nucleic Acid
gtctctgaggctagctacaacgatgggctcc

SEQ ID NO: 19732 - DNA, 31 bp, Artificial Sequence
  Description of Artificial Sequence:  Enzymatic Nucleic Acid
aacgtgggggctagctacaacgactctgact

SEQ ID NO: 19733 - DNA, 31 bp, Artificial Sequence
  Description of Artificial Sequence:  Enzymatic Nucleic Acid
tgaaaacgggctagctacaacgagggtctct

SEQ ID NO: 19734 - DNA, 31 bp, Artificial Sequence
  Description of Artificial Sequence:  Enzymatic Nucleic Acid
tctgaaaaggctagctacaacgagtgggtct

SEQ ID NO: 19735 - DNA, 31 bp, Artificial Sequence
  Description of Artificial Sequence:  Enzymatic Nucleic Acid
tccaccaaggctagctacaacgatctgaaaa

SEQ ID NO: 19736 - DNA, 31 bp, Artificial Sequence
  Description of Artificial Sequence:  Enzymatic Nucleic Acid
atgttccaggctagctacaacgacaactctg

SEQ ID NO: 19737 - DNA, 31 bp, Artificial Sequence
  Description of Artificial Sequence:  Enzymatic Nucleic Acid
cccaaatgggctagctacaacgatccaccaa

SEQ ID NO: 19738 - DNA, 31 bp, Artificial Sequence
  Description of Artificial Sequence:  Enzymatic Nucleic Acid
ttcccaaaggctagctacaacgagttccacc

SEQ ID NO: 19739 - DNA, 31 bp, Artificial Sequence
  Description of Artificial Sequence:  Enzymatic Nucleic Acid
gcaagagaggctagctacaacgattcccaaa

SEQ ID NO: 19740 - DNA, 31 bp, Artificial Sequence
  Description of Artificial Sequence:  Enzymatic Nucleic Acid
ttagcttgggctagctacaacgaaagagatt

SEQ ID NO: 19741 - DNA, 31 bp, Artificial Sequence
  Description of Artificial Sequence:  Enzymatic Nucleic Acid
agcattagggctagctacaacgattgcaaga

SEQ ID NO: 19742 - DNA, 31 bp, Artificial Sequence
  Description of Artificial Sequence:  Enzymatic Nucleic Acid
gctgagcaggctagctacaacgatagcttgc

SEQ ID NO: 19743 - DNA, 31 bp, Artificial Sequence
  Description of Artificial Sequence:  Enzymatic Nucleic Acid
ctgctgagggctagctacaacgaattagctt

SEQ ID NO: 19744 - DNA, 31 bp, Artificial Sequence
  Description of Artificial Sequence:  Enzymatic Nucleic Acid
ccatcctgggctagctacaacgatgagcatt

SEQ ID NO: 19745 - DNA, 31 bp, Artificial Sequence
  Description of Artificial Sequence:  Enzymatic Nucleic Acid
ctttgccaggctagctacaacgacctgctga

SEQ ID NO: 19746 - DNA, 31 bp, Artificial Sequence
  Description of Artificial Sequence:  Enzymatic Nucleic Acid
agtctttgggctagctacaacgacatcctgc

SEQ ID NO: 19747 - DNA, 31 bp, Artificial Sequence
  Description of Artificial Sequence:  Enzymatic Nucleic Acid
caatgtagggctagctacaacgactttgcca

SEQ ID NO: 19748 - DNA, 31 bp, Artificial Sequence
  Description of Artificial Sequence:  Enzymatic Nucleic Acid
gaacaatgggctagctacaacgaagtctttg

SEQ ID NO: 19749 - DNA, 31 bp, Artificial Sequence
  Description of Artificial Sequence:  Enzymatic Nucleic Acid
aagaacaaggctagctacaacgagtagtctt

SEQ ID NO: 19750 - DNA, 31 bp, Artificial Sequence
  Description of Artificial Sequence:  Enzymatic Nucleic Acid
cggaagaaggctagctacaacgaaatgtagt

SEQ ID NO: 19751 - DNA, 31 bp, Artificial Sequence
  Description of Artificial Sequence:  Enzymatic Nucleic Acid
ctctgataggctagctacaacgacggaagaa

SEQ ID NO: 19752 - DNA, 31 bp, Artificial Sequence
  Description of Artificial Sequence:  Enzymatic Nucleic Acid
gtctctgaggctagctacaacgaatcggaag

SEQ ID NO: 19753 - DNA, 31 bp, Artificial Sequence
  Description of Artificial Sequence:  Enzymatic Nucleic Acid
gctcaaagggctagctacaacgactctgata

SEQ ID NO: 19754 - DNA, 31 bp, Artificial Sequence
  Description of Artificial Sequence:  Enzymatic Nucleic Acid
cttccatgggctagctacaacgatcaaagtc

SEQ ID NO: 19755 - DNA, 31 bp, Artificial Sequence
  Description of Artificial Sequence:  Enzymatic Nucleic Acid
ctcttccaggctagctacaacgagctcaaag

SEQ ID NO: 19756 - DNA, 31 bp, Artificial Sequence
  Description of Artificial Sequence:  Enzymatic Nucleic Acid
gtccagaaggctagctacaacgacctcttcc

SEQ ID NO: 19757 - DNA, 31 bp, Artificial Sequence
  Description of Artificial Sequence:  Enzymatic Nucleic Acid
agagagagggctagctacaacgaccagaatc

SEQ ID NO: 19758 - DNA, 31 bp, Artificial Sequence
  Description of Artificial Sequence:  Enzymatic Nucleic Acid
gaggtaggggctagctacaacgaagagagag

SEQ ID NO: 19759 - DNA, 31 bp, Artificial Sequence
  Description of Artificial Sequence:  Enzymatic Nucleic Acid
aggtgaggggctagctacaacgaaggcagag

SEQ ID NO: 19760 - DNA, 31 bp, Artificial Sequence
  Description of Artificial Sequence:  Enzymatic Nucleic Acid
gaaacaggggctagctacaacgagaggtagg

SEQ ID NO: 19761 - DNA, 31 bp, Artificial Sequence
  Description of Artificial Sequence:  Enzymatic Nucleic Acid
acaggaaaggctagctacaacgaaggtgagg

SEQ ID NO: 19762 - DNA, 31 bp, Artificial Sequence
  Description of Artificial Sequence:  Enzymatic Nucleic Acid
cctccataggctagctacaacgaaggaaaca

SEQ ID NO: 19763 - DNA, 31 bp, Artificial Sequence
  Description of Artificial Sequence:  Enzymatic Nucleic Acid
ctcctccaggctagctacaacgaacaggaaa

SEQ ID NO: 19764 - DNA, 31 bp, Artificial Sequence
  Description of Artificial Sequence:  Enzymatic Nucleic Acid
gtcacataggctagctacaacgattcctcct

SEQ ID NO: 19765 - DNA, 31 bp, Artificial Sequence
  Description of Artificial Sequence:  Enzymatic Nucleic Acid
gggtcacaggctagctacaacgaacttcctc

SEQ ID NO: 19766 - DNA, 31 bp, Artificial Sequence
  Description of Artificial Sequence:  Enzymatic Nucleic Acid
tggggtcaggctagctacaacgaatacttcc

SEQ ID NO: 19767 - DNA, 31 bp, Artificial Sequence
  Description of Artificial Sequence:  Enzymatic Nucleic Acid
atttggggggctagctacaacgacacatact

SEQ ID NO: 19768 - DNA, 31 bp, Artificial Sequence
  Description of Artificial Sequence:  Enzymatic Nucleic Acid
taatggaaggctagctacaacgattggggtc

SEQ ID NO: 19769 - DNA, 31 bp, Artificial Sequence
  Description of Artificial Sequence:  Enzymatic Nucleic Acid
tgtcataaggctagctacaacgaggaatttg

SEQ ID NO: 19770 - DNA, 31 bp, Artificial Sequence
  Description of Artificial Sequence:  Enzymatic Nucleic Acid
tgttgtcaggctagctacaacgaaatggaat

SEQ ID NO: 19771 - DNA, 31 bp, Artificial Sequence
  Description of Artificial Sequence:  Enzymatic Nucleic Acid
ctgtgttgggctagctacaacgacataatgg

SEQ ID NO: 19772 - DNA, 31 bp, Artificial Sequence
  Description of Artificial Sequence:  Enzymatic Nucleic Acid
ctgctgtgggctagctacaacgatgtcataa

SEQ ID NO: 19773 - DNA, 31 bp, Artificial Sequence
  Description of Artificial Sequence:  Enzymatic Nucleic Acid
tcctgctgggctagctacaacgagttgtcat

SEQ ID NO: 19774 - DNA, 31 bp, Artificial Sequence
  Description of Artificial Sequence:  Enzymatic Nucleic Acid
gattcctgggctagctacaacgatgtgttgt

SEQ ID NO: 19775 - DNA, 31 bp, Artificial Sequence
  Description of Artificial Sequence:  Enzymatic Nucleic Acid
ctgactgaggctagctacaacgatcctgctg

SEQ ID NO: 19776 - DNA, 31 bp, Artificial Sequence
  Description of Artificial Sequence:  Enzymatic Nucleic Acid
gatactgaggctagctacaacgatgattcct

SEQ ID NO: 19777 - DNA, 31 bp, Artificial Sequence
  Description of Artificial Sequence:  Enzymatic Nucleic Acid
tgcagataggctagctacaacgatgactgat

SEQ ID NO: 19778 - DNA, 31 bp, Artificial Sequence
  Description of Artificial Sequence:  Enzymatic Nucleic Acid
tctgcagaggctagctacaacgaactgactg

SEQ ID NO: 19779 - DNA, 31 bp, Artificial Sequence
  Description of Artificial Sequence:  Enzymatic Nucleic Acid
ctgttctgggctagctacaacgaagatactg

SEQ ID NO: 19780 - DNA, 31 bp, Artificial Sequence
  Description of Artificial Sequence:  Enzymatic Nucleic Acid
gcttactgggctagctacaacgatctgcaga

SEQ ID NO: 19781 - DNA, 31 bp, Artificial Sequence
  Description of Artificial Sequence:  Enzymatic Nucleic Acid
ttcgcttaggctagctacaacgatgttctgc

SEQ ID NO: 19782 - DNA, 31 bp, Artificial Sequence
  Description of Artificial Sequence:  Enzymatic Nucleic Acid
ctctttcgggctagctacaacgattactgtt

SEQ ID NO: 19783 - DNA, 31 bp, Artificial Sequence
  Description of Artificial Sequence:  Enzymatic Nucleic Acid
caggccggggctagctacaacgatctttcgc

SEQ ID NO: 19784 - DNA, 31 bp, Artificial Sequence
  Description of Artificial Sequence:  Enzymatic Nucleic Acid
ctcacaggggctagctacaacgacggctctt

SEQ ID NO: 19785 - DNA, 31 bp, Artificial Sequence
  Description of Artificial Sequence:  Enzymatic Nucleic Acid
tacactcaggctagctacaacgaaggccggc

SEQ ID NO: 19786 - DNA, 31 bp, Artificial Sequence
  Description of Artificial Sequence:  Enzymatic Nucleic Acid
tttttacaggctagctacaacgatcacaggc

SEQ ID NO: 19787 - DNA, 31 bp, Artificial Sequence
  Description of Artificial Sequence:  Enzymatic Nucleic Acid
tgtttttaggctagctacaacgaactcacag

SEQ ID NO: 19788 - DNA, 31 bp, Artificial Sequence
  Description of Artificial Sequence:  Enzymatic Nucleic Acid
ttcaaatgggctagctacaacgattttacac

SEQ ID NO: 19789 - DNA, 31 bp, Artificial Sequence
  Description of Artificial Sequence:  Enzymatic Nucleic Acid
tcttcaaaggctagctacaacgagtttttac

SEQ ID NO: 19790 - DNA, 31 bp, Artificial Sequence
  Description of Artificial Sequence:  Enzymatic Nucleic Acid
acgggataggctagctacaacgacttcaaat

SEQ ID NO: 19791 - DNA, 31 bp, Artificial Sequence
  Description of Artificial Sequence:  Enzymatic Nucleic Acid
taacgggaggctagctacaacgaatcttcaa

SEQ ID NO: 19792 - DNA, 31 bp, Artificial Sequence
  Description of Artificial Sequence:  Enzymatic Nucleic Acid
tcttctaaggctagctacaacgagggatatc

SEQ ID NO: 19793 - DNA, 31 bp, Artificial Sequence
  Description of Artificial Sequence:  Enzymatic Nucleic Acid
acttctggggctagctacaacgatcttctaa

SEQ ID NO: 19794 - DNA, 31 bp, Artificial Sequence
  Description of Artificial Sequence:  Enzymatic Nucleic Acid
tacttttaggctagctacaacgattctggtt

SEQ ID NO: 19795 - DNA, 31 bp, Artificial Sequence
  Description of Artificial Sequence:  Enzymatic Nucleic Acid
tgggattaggctagctacaacgattttactt

SEQ ID NO: 19796 - DNA, 31 bp, Artificial Sequence
  Description of Artificial Sequence:  Enzymatic Nucleic Acid
atctgggaggctagctacaacgatactttta

SEQ ID NO: 19797 - DNA, 31 bp, Artificial Sequence
  Description of Artificial Sequence:  Enzymatic Nucleic Acid
ggttgtcaggctagctacaacgactgggatt

SEQ ID NO: 19798 - DNA, 31 bp, Artificial Sequence
  Description of Artificial Sequence:  Enzymatic Nucleic Acid
tctggttgggctagctacaacgacatctggg

SEQ ID NO: 19799 - DNA, 31 bp, Artificial Sequence
  Description of Artificial Sequence:  Enzymatic Nucleic Acid
ccgtctggggctagctacaacgatgtcatct

SEQ ID NO: 19800 - DNA, 31 bp, Artificial Sequence
  Description of Artificial Sequence:  Enzymatic Nucleic Acid
actgtccgggctagctacaacgactggttgt

SEQ ID NO: 19801 - DNA, 31 bp, Artificial Sequence
  Description of Artificial Sequence:  Enzymatic Nucleic Acid
taccactgggctagctacaacgaccgtctgg

SEQ ID NO: 19802 - DNA, 31 bp, Artificial Sequence
  Description of Artificial Sequence:  Enzymatic Nucleic Acid
ccataccaggctagctacaacgatgtccgtc

SEQ ID NO: 19803 - DNA, 31 bp, Artificial Sequence
  Description of Artificial Sequence:  Enzymatic Nucleic Acid
gaaccataggctagctacaacgacactgtcc

SEQ ID NO: 19804 - DNA, 31 bp, Artificial Sequence
  Description of Artificial Sequence:  Enzymatic Nucleic Acid
aagaaccaggctagctacaacgaaccactgt

SEQ ID NO: 19805 - DNA, 31 bp, Artificial Sequence
  Description of Artificial Sequence:  Enzymatic Nucleic Acid
ggcaagaaggctagctacaacgacataccac

SEQ ID NO: 19806 - DNA, 31 bp, Artificial Sequence
  Description of Artificial Sequence:  Enzymatic Nucleic Acid
ttctgaggggctagctacaacgaaagaacca

SEQ ID NO: 19807 - DNA, 31 bp, Artificial Sequence
  Description of Artificial Sequence:  Enzymatic Nucleic Acid
gttttcagggctagctacaacgatcttctga

SEQ ID NO: 19808 - DNA, 31 bp, Artificial Sequence
  Description of Artificial Sequence:  Enzymatic Nucleic Acid
ttccaaagggctagctacaacgatttcagct

SEQ ID NO: 19809 - DNA, 31 bp, Artificial Sequence
  Description of Artificial Sequence:  Enzymatic Nucleic Acid
tggttctgggctagctacaacgacttccaaa

SEQ ID NO: 19810 - DNA, 31 bp, Artificial Sequence
  Description of Artificial Sequence:  Enzymatic Nucleic Acid
taatttggggctagctacaacgatctgtctt

SEQ ID NO: 19811 - DNA, 31 bp, Artificial Sequence
  Description of Artificial Sequence:  Enzymatic Nucleic Acid
ggagataaggctagctacaacgattggttct

SEQ ID NO: 19812 - DNA, 31 bp, Artificial Sequence
  Description of Artificial Sequence:  Enzymatic Nucleic Acid
gatggagaggctagctacaacgaaatttggt

SEQ ID NO: 19813 - DNA, 31 bp, Artificial Sequence
  Description of Artificial Sequence:  Enzymatic Nucleic Acid
ccaaaagaggctagctacaacgaggagataa

SEQ ID NO: 19814 - DNA, 31 bp, Artificial Sequence
  Description of Artificial Sequence:  Enzymatic Nucleic Acid
ccattccaggctagctacaacgacaaaagat

SEQ ID NO: 19815 - DNA, 31 bp, Artificial Sequence
  Description of Artificial Sequence:  Enzymatic Nucleic Acid
gggcaccaggctagctacaacgatccaccaa

SEQ ID NO: 19816 - DNA, 31 bp, Artificial Sequence
  Description of Artificial Sequence:  Enzymatic Nucleic Acid
gctgggcaggctagctacaacgacattccac

SEQ ID NO: 19817 - DNA, 31 bp, Artificial Sequence
  Description of Artificial Sequence:  Enzymatic Nucleic Acid
ttgctgggggctagctacaacgaaccattcc

SEQ ID NO: 19818 - DNA, 31 bp, Artificial Sequence
  Description of Artificial Sequence:  Enzymatic Nucleic Acid
tgcttttgggctagctacaacgatgggcacc

SEQ ID NO: 19819 - DNA, 31 bp, Artificial Sequence
  Description of Artificial Sequence:  Enzymatic Nucleic Acid
actccctgggctagctacaacgattttgctg

SEQ ID NO: 19820 - DNA, 31 bp, Artificial Sequence
  Description of Artificial Sequence:  Enzymatic Nucleic Acid
gccacagaggctagctacaacgatccctgct

SEQ ID NO: 19821 - DNA, 31 bp, Artificial Sequence
  Description of Artificial Sequence:  Enzymatic Nucleic Acid
agatgccaggctagctacaacgaagactccc

SEQ ID NO: 19822 - DNA, 31 bp, Artificial Sequence
  Description of Artificial Sequence:  Enzymatic Nucleic Acid
ttcagatgggctagctacaacgacacagact

SEQ ID NO: 19823 - DNA, 31 bp, Artificial Sequence
  Description of Artificial Sequence:  Enzymatic Nucleic Acid
ccttcagaggctagctacaacgagccacaga

SEQ ID NO: 19824 - DNA, 31 bp, Artificial Sequence
  Description of Artificial Sequence:  Enzymatic Nucleic Acid
ggtttgagggctagctacaacgacttcagat

SEQ ID NO: 19825 - DNA, 31 bp, Artificial Sequence
  Description of Artificial Sequence:  Enzymatic Nucleic Acid
ttgtctggggctagctacaacgattgagcct

SEQ ID NO: 19826 - DNA, 31 bp, Artificial Sequence
  Description of Artificial Sequence:  Enzymatic Nucleic Acid
gccgcttgggctagctacaacgactggtttg

SEQ ID NO: 19827 - DNA, 31 bp, Artificial Sequence
  Description of Artificial Sequence:  Enzymatic Nucleic Acid
ggtagccgggctagctacaacgattgtctgg

SEQ ID NO: 19828 - DNA, 31 bp, Artificial Sequence
  Description of Artificial Sequence:  Enzymatic Nucleic Acid
actggtagggctagctacaacgacgcttgtc

SEQ ID NO: 19829 - DNA, 31 bp, Artificial Sequence
  Description of Artificial Sequence:  Enzymatic Nucleic Acid
cggactggggctagctacaacgaagccgctt

SEQ ID NO: 19830 - DNA, 31 bp, Artificial Sequence
  Description of Artificial Sequence:  Enzymatic Nucleic Acid
tatccggaggctagctacaacgatggtagcc

SEQ ID NO: 19831 - DNA, 31 bp, Artificial Sequence
  Description of Artificial Sequence:  Enzymatic Nucleic Acid
gagtgataggctagctacaacgaccggactg

SEQ ID NO: 19832 - DNA, 31 bp, Artificial Sequence
  Description of Artificial Sequence:  Enzymatic Nucleic Acid
cggagtgaggctagctacaacgaatccggac

SEQ ID NO: 19833 - DNA, 31 bp, Artificial Sequence
  Description of Artificial Sequence:  Enzymatic Nucleic Acid
catcggagggctagctacaacgagatatccg

SEQ ID NO: 19834 - DNA, 31 bp, Artificial Sequence
  Description of Artificial Sequence:  Enzymatic Nucleic Acid
ctgtgtcaggctagctacaacgacggagtga

SEQ ID NO: 19835 - DNA, 31 bp, Artificial Sequence
  Description of Artificial Sequence:  Enzymatic Nucleic Acid
tgtctgtgggctagctacaacgacatcggag

SEQ ID NO: 19836 - DNA, 31 bp, Artificial Sequence
  Description of Artificial Sequence:  Enzymatic Nucleic Acid
ggtgtctgggctagctacaacgagtcatcgg

SEQ ID NO: 19837 - DNA, 31 bp, Artificial Sequence
  Description of Artificial Sequence:  Enzymatic Nucleic Acid
cggtggtgggctagctacaacgactgtgtca

SEQ ID NO: 19838 - DNA, 31 bp, Artificial Sequence
  Description of Artificial Sequence:  Enzymatic Nucleic Acid
cacggtggggctagctacaacgagtctgtgt

SEQ ID NO: 19839 - DNA, 31 bp, Artificial Sequence
  Description of Artificial Sequence:  Enzymatic Nucleic Acid
gtacacggggctagctacaacgaggtgtctg

SEQ ID NO: 19840 - DNA, 31 bp, Artificial Sequence
  Description of Artificial Sequence:  Enzymatic Nucleic Acid
ggagtacaggctagctacaacgaggtggtgt

SEQ ID NO: 19841 - DNA, 31 bp, Artificial Sequence
  Description of Artificial Sequence:  Enzymatic Nucleic Acid
ctggagtaggctagctacaacgaacggtggt

SEQ ID NO: 19842 - DNA, 31 bp, Artificial Sequence
  Description of Artificial Sequence:  Enzymatic Nucleic Acid
cactggagggctagctacaacgaacacggtg

SEQ ID NO: 19843 - DNA, 31 bp, Artificial Sequence
  Description of Artificial Sequence:  Enzymatic Nucleic Acid
cttcctcaggctagctacaacgatggagtac

SEQ ID NO: 19844 - DNA, 31 bp, Artificial Sequence
  Description of Artificial Sequence:  Enzymatic Nucleic Acid
aagttctgggctagctacaacgattcctcac

SEQ ID NO: 19845 - DNA, 31 bp, Artificial Sequence
  Description of Artificial Sequence:  Enzymatic Nucleic Acid
tttaaaagggctagctacaacgatctgcttc

SEQ ID NO: 19846 - DNA, 31 bp, Artificial Sequence
  Description of Artificial Sequence:  Enzymatic Nucleic Acid
tctatcagggctagctacaacgatttaaaag

SEQ ID NO: 19847 - DNA, 31 bp, Artificial Sequence
  Description of Artificial Sequence:  Enzymatic Nucleic Acid
aatctctaggctagctacaacgacagcttta

SEQ ID NO: 19848 - DNA, 31 bp, Artificial Sequence
  Description of Artificial Sequence:  Enzymatic Nucleic Acid
cactccaaggctagctacaacgactctatca

SEQ ID NO: 19849 - DNA, 31 bp, Artificial Sequence
  Description of Artificial Sequence:  Enzymatic Nucleic Acid
ggtttgcaggctagctacaacgatccaatct

SEQ ID NO: 19850 - DNA, 31 bp, Artificial Sequence
  Description of Artificial Sequence:  Enzymatic Nucleic Acid
ccggtttgggctagctacaacgaactccaat

SEQ ID NO: 19851 - DNA, 31 bp, Artificial Sequence
  Description of Artificial Sequence:  Enzymatic Nucleic Acid
gctaccggggctagctacaacgattgcactc

SEQ ID NO: 19852 - DNA, 31 bp, Artificial Sequence
  Description of Artificial Sequence:  Enzymatic Nucleic Acid
ctgtgctaggctagctacaacgacggtttgc

SEQ ID NO: 19853 - DNA, 31 bp, Artificial Sequence
  Description of Artificial Sequence:  Enzymatic Nucleic Acid
gggctgtgggctagctacaacgataccggtt

SEQ ID NO: 19854 - DNA, 31 bp, Artificial Sequence
  Description of Artificial Sequence:  Enzymatic Nucleic Acid
ctgggctgggctagctacaacgagctaccgg

SEQ ID NO: 19855 - DNA, 31 bp, Artificial Sequence
  Description of Artificial Sequence:  Enzymatic Nucleic Acid
aatctgggggctagctacaacgatgtgctac

SEQ ID NO: 19856 - DNA, 31 bp, Artificial Sequence
  Description of Artificial Sequence:  Enzymatic Nucleic Acid
ctggagaaggctagctacaacgactgggctg

SEQ ID NO: 19857 - DNA, 31 bp, Artificial Sequence
  Description of Artificial Sequence:  Enzymatic Nucleic Acid
gagtcaggggctagctacaacgatggagaat

SEQ ID NO: 19858 - DNA, 31 bp, Artificial Sequence
  Description of Artificial Sequence:  Enzymatic Nucleic Acid
tccccgagggctagctacaacgacaggctgg

SEQ ID NO: 19859 - DNA, 31 bp, Artificial Sequence
  Description of Artificial Sequence:  Enzymatic Nucleic Acid
cagtgtggggctagctacaacgaccccgagt

SEQ ID NO: 19860 - DNA, 31 bp, Artificial Sequence
  Description of Artificial Sequence:  Enzymatic Nucleic Acid
gctcagtgggctagctacaacgaggtccccg

SEQ ID NO: 19861 - DNA, 31 bp, Artificial Sequence
  Description of Artificial Sequence:  Enzymatic Nucleic Acid
gagctcagggctagctacaacgagtggtccc

SEQ ID NO: 19862 - DNA, 31 bp, Artificial Sequence
  Description of Artificial Sequence:  Enzymatic Nucleic Acid
gaggagagggctagctacaacgatcagtgtg

SEQ ID NO: 19863 - DNA, 31 bp, Artificial Sequence
  Description of Artificial Sequence:  Enzymatic Nucleic Acid
cttttaaaggctagctacaacgaaggaggag

SEQ ID NO: 19864 - DNA, 31 bp, Artificial Sequence
  Description of Artificial Sequence:  Enzymatic Nucleic Acid
tgtggatgggctagctacaacgattcctttt

SEQ ID NO: 19865 - DNA, 31 bp, Artificial Sequence
  Description of Artificial Sequence:  Enzymatic Nucleic Acid
ggtgtggaggctagctacaacgagcttcctt

SEQ ID NO: 19866 - DNA, 31 bp, Artificial Sequence
  Description of Artificial Sequence:  Enzymatic Nucleic Acid
ttggggtgggctagctacaacgaggatgctt

SEQ ID NO: 19867 - DNA, 31 bp, Artificial Sequence
  Description of Artificial Sequence:  Enzymatic Nucleic Acid
agttggggggctagctacaacgagtggatgc

SEQ ID NO: 19868 - DNA, 31 bp, Artificial Sequence
  Description of Artificial Sequence:  Enzymatic Nucleic Acid
tccgggagggctagctacaacgatggggtgt

SEQ ID NO: 19869 - DNA, 31 bp, Artificial Sequence
  Description of Artificial Sequence:  Enzymatic Nucleic Acid
atgtgatgggctagctacaacgaccgggagt

SEQ ID NO: 19870 - DNA, 31 bp, Artificial Sequence
  Description of Artificial Sequence:  Enzymatic Nucleic Acid
tcatgtgaggctagctacaacgagtccggga

SEQ ID NO: 19871 - DNA, 31 bp, Artificial Sequence
  Description of Artificial Sequence:  Enzymatic Nucleic Acid
ctctcatgggctagctacaacgagatgtccg

SEQ ID NO: 19872 - DNA, 31 bp, Artificial Sequence
  Description of Artificial Sequence:  Enzymatic Nucleic Acid
acctctcaggctagctacaacgagtgatgtc

SEQ ID NO: 19873 - DNA, 31 bp, Artificial Sequence
  Description of Artificial Sequence:  Enzymatic Nucleic Acid
tgagcagaggctagctacaacgactctcatg

SEQ ID NO: 19874 - DNA, 31 bp, Artificial Sequence
  Description of Artificial Sequence:  Enzymatic Nucleic Acid
aatctgagggctagctacaacgaagacctct

SEQ ID NO: 19875 - DNA, 31 bp, Artificial Sequence
  Description of Artificial Sequence:  Enzymatic Nucleic Acid
cttcaaaaggctagctacaacgactgagcag

SEQ ID NO: 19876 - DNA, 31 bp, Artificial Sequence
  Description of Artificial Sequence:  Enzymatic Nucleic Acid
gaacaacaggctagctacaacgattcaaaat

SEQ ID NO: 19877 - DNA, 31 bp, Artificial Sequence
  Description of Artificial Sequence:  Enzymatic Nucleic Acid
aagaacaaggctagctacaacgaacttcaaa

SEQ ID NO: 19878 - DNA, 31 bp, Artificial Sequence
  Description of Artificial Sequence:  Enzymatic Nucleic Acid
ggaaagaaggctagctacaacgaaacacttc

SEQ ID NO: 19879 - DNA, 31 bp, Artificial Sequence
  Description of Artificial Sequence:  Enzymatic Nucleic Acid
cctgctggggctagctacaacgaggaaagaa

SEQ ID NO: 19880 - DNA, 31 bp, Artificial Sequence
  Description of Artificial Sequence:  Enzymatic Nucleic Acid
acttcctgggctagctacaacgatggtggaa

SEQ ID NO: 19881 - DNA, 31 bp, Artificial Sequence
  Description of Artificial Sequence:  Enzymatic Nucleic Acid
tgcggctaggctagctacaacgattcctgct

SEQ ID NO: 19882 - DNA, 31 bp, Artificial Sequence
  Description of Artificial Sequence:  Enzymatic Nucleic Acid
aaatgcggggctagctacaacgatacttcct

SEQ ID NO: 19883 - DNA, 31 bp, Artificial Sequence
  Description of Artificial Sequence:  Enzymatic Nucleic Acid
atcaaatgggctagctacaacgaggctactt

SEQ ID NO: 19884 - DNA, 31 bp, Artificial Sequence
  Description of Artificial Sequence:  Enzymatic Nucleic Acid
aaatcaaaggctagctacaacgagcggctac

SEQ ID NO: 19885 - DNA, 31 bp, Artificial Sequence
  Description of Artificial Sequence:  Enzymatic Nucleic Acid
aatgaaaaggctagctacaacgacaaatgcg

SEQ ID NO: 19886 - DNA, 31 bp, Artificial Sequence
  Description of Artificial Sequence:  Enzymatic Nucleic Acid
tgtcgaaaggctagctacaacgagaaaatca

SEQ ID NO: 19887 - DNA, 31 bp, Artificial Sequence
  Description of Artificial Sequence:  Enzymatic Nucleic Acid
ttctgttgggctagctacaacgacgaaatga

SEQ ID NO: 19888 - DNA, 31 bp, Artificial Sequence
  Description of Artificial Sequence:  Enzymatic Nucleic Acid
tttttctgggctagctacaacgatgtcgaaa

SEQ ID NO: 19889 - DNA, 31 bp, Artificial Sequence
  Description of Artificial Sequence:  Enzymatic Nucleic Acid
gtccgaggggctagctacaacgacctttttc

SEQ ID NO: 19890 - DNA, 31 bp, Artificial Sequence
  Description of Artificial Sequence:  Enzymatic Nucleic Acid
ccctgcagggctagctacaacgaccgaggtc

SEQ ID NO: 19891 - DNA, 31 bp, Artificial Sequence
  Description of Artificial Sequence:  Enzymatic Nucleic Acid
gctccctgggctagctacaacgaagtccgag

SEQ ID NO: 19892 - DNA, 31 bp, Artificial Sequence
  Description of Artificial Sequence:  Enzymatic Nucleic Acid
aagactggggctagctacaacgatccctgca

SEQ ID NO: 19893 - DNA, 31 bp, Artificial Sequence
  Description of Artificial Sequence:  Enzymatic Nucleic Acid
ctagaagaggctagctacaacgatggctccc

SEQ ID NO: 19894 - DNA, 31 bp, Artificial Sequence
  Description of Artificial Sequence:  Enzymatic Nucleic Acid
aggatatgggctagctacaacgactagaaga

SEQ ID NO: 19895 - DNA, 31 bp, Artificial Sequence
  Description of Artificial Sequence:  Enzymatic Nucleic Acid
ccaggataggctagctacaacgagcctagaa

SEQ ID NO: 19896 - DNA, 31 bp, Artificial Sequence
  Description of Artificial Sequence:  Enzymatic Nucleic Acid
ttccaggaggctagctacaacgaatgcctag

SEQ ID NO: 19897 - DNA, 31 bp, Artificial Sequence
  Description of Artificial Sequence:  Enzymatic Nucleic Acid
gtcacaagggctagctacaacgactcttcca

SEQ ID NO: 19898 - DNA, 31 bp, Artificial Sequence
  Description of Artificial Sequence:  Enzymatic Nucleic Acid
ttgggtcaggctagctacaacgaaagcctct

SEQ ID NO: 19899 - DNA, 31 bp, Artificial Sequence
  Description of Artificial Sequence:  Enzymatic Nucleic Acid
ttcttgggggctagctacaacgacacaagcc

SEQ ID NO: 19900 - DNA, 31 bp, Artificial Sequence
  Description of Artificial Sequence:  Enzymatic Nucleic Acid
cagacacaggctagctacaacgatcttgggt

SEQ ID NO: 19901 - DNA, 31 bp, Artificial Sequence
  Description of Artificial Sequence:  Enzymatic Nucleic Acid
cacagacaggctagctacaacgaattcttgg

SEQ ID NO: 19902 - DNA, 31 bp, Artificial Sequence
  Description of Artificial Sequence:  Enzymatic Nucleic Acid
gacacagaggctagctacaacgaacattctt

SEQ ID NO: 19903 - DNA, 31 bp, Artificial Sequence
  Description of Artificial Sequence:  Enzymatic Nucleic Acid
agaagacaggctagctacaacgaagacacat

SEQ ID NO: 19904 - DNA, 31 bp, Artificial Sequence
  Description of Artificial Sequence:  Enzymatic Nucleic Acid
ggagaagaggctagctacaacgaacagacac

SEQ ID NO: 19905 - DNA, 31 bp, Artificial Sequence
  Description of Artificial Sequence:  Enzymatic Nucleic Acid
ggtcaacaggctagctacaacgatgggagaa

SEQ ID NO: 19906 - DNA, 31 bp, Artificial Sequence
  Description of Artificial Sequence:  Enzymatic Nucleic Acid
caggtcaaggctagctacaacgaactgggag

SEQ ID NO: 19907 - DNA, 31 bp, Artificial Sequence
  Description of Artificial Sequence:  Enzymatic Nucleic Acid
ggatcaggggctagctacaacgacaacactg

SEQ ID NO: 19908 - DNA, 31 bp, Artificial Sequence
  Description of Artificial Sequence:  Enzymatic Nucleic Acid
aaagaggaggctagctacaacgacaggtcaa

SEQ ID NO: 19909 - DNA, 31 bp, Artificial Sequence
  Description of Artificial Sequence:  Enzymatic Nucleic Acid
taaatgaaggctagctacaacgagaaaaaag

SEQ ID NO: 19910 - DNA, 31 bp, Artificial Sequence
  Description of Artificial Sequence:  Enzymatic Nucleic Acid
tttttaaaggctagctacaacgagaatgaaa

SEQ ID NO: 19911 - DNA, 31 bp, Artificial Sequence
  Description of Artificial Sequence:  Enzymatic Nucleic Acid
tgataatgggctagctacaacgatttttaaa

SEQ ID NO: 19912 - DNA, 31 bp, Artificial Sequence
  Description of Artificial Sequence:  Enzymatic Nucleic Acid
catgataaggctagctacaacgagcttttta

SEQ ID NO: 19913 - DNA, 31 bp, Artificial Sequence
  Description of Artificial Sequence:  Enzymatic Nucleic Acid
gggcatgaggctagctacaacgaaatgcttt

SEQ ID NO: 19914 - DNA, 31 bp, Artificial Sequence
  Description of Artificial Sequence:  Enzymatic Nucleic Acid
caggggcaggctagctacaacgagataatgc

SEQ ID NO: 19915 - DNA, 31 bp, Artificial Sequence
  Description of Artificial Sequence:  Enzymatic Nucleic Acid
agcaggggggctagctacaacgaatgataat

SEQ ID NO: 19916 - DNA, 31 bp, Artificial Sequence
  Description of Artificial Sequence:  Enzymatic Nucleic Acid
acccgcagggctagctacaacgaaggggcat

SEQ ID NO: 19917 - DNA, 31 bp, Artificial Sequence
  Description of Artificial Sequence:  Enzymatic Nucleic Acid
gagacccgggctagctacaacgaagcagggg

SEQ ID NO: 19918 - DNA, 31 bp, Artificial Sequence
  Description of Artificial Sequence:  Enzymatic Nucleic Acid
tggtgagaggctagctacaacgaccgcagca

SEQ ID NO: 19919 - DNA, 31 bp, Artificial Sequence
  Description of Artificial Sequence:  Enzymatic Nucleic Acid
acccatggggctagctacaacgagagacccg

SEQ ID NO: 19920 - DNA, 31 bp, Artificial Sequence
  Description of Artificial Sequence:  Enzymatic Nucleic Acid
taaacccaggctagctacaacgaggtgagac

SEQ ID NO: 19921 - DNA, 31 bp, Artificial Sequence
  Description of Artificial Sequence:  Enzymatic Nucleic Acid
gttctaaaggctagctacaacgaccatggtg

SEQ ID NO: 19922 - DNA, 31 bp, Artificial Sequence
  Description of Artificial Sequence:  Enzymatic Nucleic Acid
gctctttgggctagctacaacgatctaaacc

SEQ ID NO: 19923 - DNA, 31 bp, Artificial Sequence
  Description of Artificial Sequence:  Enzymatic Nucleic Acid
gcttgaagggctagctacaacgatctttgtt

SEQ ID NO: 19924 - DNA, 31 bp, Artificial Sequence
  Description of Artificial Sequence:  Enzymatic Nucleic Acid
ggccattgggctagctacaacgattgaagct

SEQ ID NO: 19925 - DNA, 31 bp, Artificial Sequence
  Description of Artificial Sequence:  Enzymatic Nucleic Acid
tggggccaggctagctacaacgatgcttgaa

SEQ ID NO: 19926 - DNA, 31 bp, Artificial Sequence
  Description of Artificial Sequence:  Enzymatic Nucleic Acid
ggatggggggctagctacaacgacattgctt

SEQ ID NO: 19927 - DNA, 31 bp, Artificial Sequence
  Description of Artificial Sequence:  Enzymatic Nucleic Acid
tttgaggaggctagctacaacgaggggccat

SEQ ID NO: 19928 - DNA, 31 bp, Artificial Sequence
  Description of Artificial Sequence:  Enzymatic Nucleic Acid
tactgctaggctagctacaacgattctttga

SEQ ID NO: 19929 - DNA, 31 bp, Artificial Sequence
  Description of Artificial Sequence:  Enzymatic Nucleic Acid
aggtactgggctagctacaacgatacttctt

SEQ ID NO: 19930 - DNA, 31 bp, Artificial Sequence
  Description of Artificial Sequence:  Enzymatic Nucleic Acid
cccaggtaggctagctacaacgatgctactt

SEQ ID NO: 19931 - DNA, 31 bp, Artificial Sequence
  Description of Artificial Sequence:  Enzymatic Nucleic Acid
tccccaggggctagctacaacgaactgctac

SEQ ID NO: 19932 - DNA, 31 bp, Artificial Sequence
  Description of Artificial Sequence:  Enzymatic Nucleic Acid
agtgtcagggctagctacaacgatccccagg

SEQ ID NO: 19933 - DNA, 31 bp, Artificial Sequence
  Description of Artificial Sequence:  Enzymatic Nucleic Acid
cagaagtgggctagctacaacgacagctccc

SEQ ID NO: 19934 - DNA, 31 bp, Artificial Sequence
  Description of Artificial Sequence:  Enzymatic Nucleic Acid
tacagaagggctagctacaacgagtcagctc

SEQ ID NO: 19935 - DNA, 31 bp, Artificial Sequence
  Description of Artificial Sequence:  Enzymatic Nucleic Acid
tagttttaggctagctacaacgaagaagtgt

SEQ ID NO: 19936 - DNA, 31 bp, Artificial Sequence
  Description of Artificial Sequence:  Enzymatic Nucleic Acid
tcttctagggctagctacaacgatttacaga

SEQ ID NO: 19937 - DNA, 31 bp, Artificial Sequence
  Description of Artificial Sequence:  Enzymatic Nucleic Acid
ctggtttaggctagctacaacgacttctagt

SEQ ID NO: 19938 - DNA, 31 bp, Artificial Sequence
  Description of Artificial Sequence:  Enzymatic Nucleic Acid
ttgcctggggctagctacaacgattatcttc

SEQ ID NO: 19939 - DNA, 31 bp, Artificial Sequence
  Description of Artificial Sequence:  Enzymatic Nucleic Acid
ttacgttgggctagctacaacgactggttta

SEQ ID NO: 19940 - DNA, 31 bp, Artificial Sequence
  Description of Artificial Sequence:  Enzymatic Nucleic Acid
cacttacgggctagctacaacgatgcctggt

SEQ ID NO: 19941 - DNA, 31 bp, Artificial Sequence
  Description of Artificial Sequence:  Enzymatic Nucleic Acid
aacacttaggctagctacaacgagttgcctg

SEQ ID NO: 19942 - DNA, 31 bp, Artificial Sequence
  Description of Artificial Sequence:  Enzymatic Nucleic Acid
ctcgaacaggctagctacaacgattacgttg

SEQ ID NO: 19943 - DNA, 31 bp, Artificial Sequence
  Description of Artificial Sequence:  Enzymatic Nucleic Acid
acctcgaaggctagctacaacgaacttacgt

SEQ ID NO: 19944 - DNA, 31 bp, Artificial Sequence
  Description of Artificial Sequence:  Enzymatic Nucleic Acid
cttcaacaggctagctacaacgactcgaaca

SEQ ID NO: 19945 - DNA, 31 bp, Artificial Sequence
  Description of Artificial Sequence:  Enzymatic Nucleic Acid
atcttcaaggctagctacaacgaacctcgaa

SEQ ID NO: 19946 - DNA, 31 bp, Artificial Sequence
  Description of Artificial Sequence:  Enzymatic Nucleic Acid
ccttcccaggctagctacaacgacttcaaca

SEQ ID NO: 19947 - DNA, 31 bp, Artificial Sequence
  Description of Artificial Sequence:  Enzymatic Nucleic Acid
cctgcaaaggctagctacaacgaccttccca

SEQ ID NO: 19948 - DNA, 31 bp, Artificial Sequence
  Description of Artificial Sequence:  Enzymatic Nucleic Acid
cagccctgggctagctacaacgaaaatcctt

SEQ ID NO: 19949 - DNA, 31 bp, Artificial Sequence
  Description of Artificial Sequence:  Enzymatic Nucleic Acid
agactcagggctagctacaacgacctgcaaa

SEQ ID NO: 19950 - DNA, 31 bp, Artificial Sequence
  Description of Artificial Sequence:  Enzymatic Nucleic Acid
tggatagaggctagctacaacgatcagccct

SEQ ID NO: 19951 - DNA, 31 bp, Artificial Sequence
  Description of Artificial Sequence:  Enzymatic Nucleic Acid
ctcttggaggctagctacaacgaagactcag

SEQ ID NO: 19952 - DNA, 31 bp, Artificial Sequence
  Description of Artificial Sequence:  Enzymatic Nucleic Acid
aaacaaagggctagctacaacgactcttgga

SEQ ID NO: 19953 - DNA, 31 bp, Artificial Sequence
  Description of Artificial Sequence:  Enzymatic Nucleic Acid
gtcctaaaggctagctacaacgaaaagcctc

SEQ ID NO: 19954 - DNA, 31 bp, Artificial Sequence
  Description of Artificial Sequence:  Enzymatic Nucleic Acid
gacccacgggctagctacaacgacctaaaca

SEQ ID NO: 19955 - DNA, 31 bp, Artificial Sequence
  Description of Artificial Sequence:  Enzymatic Nucleic Acid
gggacccaggctagctacaacgagtcctaaa

SEQ ID NO: 19956 - DNA, 31 bp, Artificial Sequence
  Description of Artificial Sequence:  Enzymatic Nucleic Acid
gcttgggaggctagctacaacgaccacgtcc

SEQ ID NO: 19957 - DNA, 31 bp, Artificial Sequence
  Description of Artificial Sequence:  Enzymatic Nucleic Acid
aggcttggggctagctacaacgattgggacc

SEQ ID NO: 19958 - DNA, 31 bp, Artificial Sequence
  Description of Artificial Sequence:  Enzymatic Nucleic Acid
acttaaggggctagctacaacgattggcttg

SEQ ID NO: 19959 - DNA, 31 bp, Artificial Sequence
  Description of Artificial Sequence:  Enzymatic Nucleic Acid
attccacaggctagctacaacgattaaggct

SEQ ID NO: 19960 - DNA, 31 bp, Artificial Sequence
  Description of Artificial Sequence:  Enzymatic Nucleic Acid
gaattccaggctagctacaacgaacttaagg

SEQ ID NO: 19961 - DNA, 31 bp, Artificial Sequence
  Description of Artificial Sequence:  Enzymatic Nucleic Acid
aatccgaaggctagctacaacgatccacact

SEQ ID NO: 19962 - DNA, 31 bp, Artificial Sequence
  Description of Artificial Sequence:  Enzymatic Nucleic Acid
tctatcaaggctagctacaacgaccgaattc

SEQ ID NO: 19963 - DNA, 31 bp, Artificial Sequence
  Description of Artificial Sequence:  Enzymatic Nucleic Acid
cctttctaggctagctacaacgacaatccga

SEQ ID NO: 19964 - DNA, 31 bp, Artificial Sequence
  Description of Artificial Sequence:  Enzymatic Nucleic Acid
aacgttagggctagctacaacgacttccttt

SEQ ID NO: 19965 - DNA, 31 bp, Artificial Sequence
  Description of Artificial Sequence:  Enzymatic Nucleic Acid
aggtaacgggctagctacaacgatagtcttc

SEQ ID NO: 19966 - DNA, 31 bp, Artificial Sequence
  Description of Artificial Sequence:  Enzymatic Nucleic Acid
caaggtaaggctagctacaacgagttagtct

SEQ ID NO: 19967 - DNA, 31 bp, Artificial Sequence
  Description of Artificial Sequence:  Enzymatic Nucleic Acid
aagcaaggggctagctacaacgaaacgttag

SEQ ID NO: 19968 - DNA, 31 bp, Artificial Sequence
  Description of Artificial Sequence:  Enzymatic Nucleic Acid
ctccaaagggctagctacaacgaaaggtaac

SEQ ID NO: 19969 - DNA, 31 bp, Artificial Sequence
  Description of Artificial Sequence:  Enzymatic Nucleic Acid
ctccagtaggctagctacaacgatctccaaa

SEQ ID NO: 19970 - DNA, 31 bp, Artificial Sequence
  Description of Artificial Sequence:  Enzymatic Nucleic Acid
ggctccagggctagctacaacgaactctcca

SEQ ID NO: 19971 - DNA, 31 bp, Artificial Sequence
  Description of Artificial Sequence:  Enzymatic Nucleic Acid
tttgcaggggctagctacaacgatccagtac

SEQ ID NO: 19972 - DNA, 31 bp, Artificial Sequence
  Description of Artificial Sequence:  Enzymatic Nucleic Acid
tgcatttgggctagctacaacgaaggctcca

SEQ ID NO: 19973 - DNA, 31 bp, Artificial Sequence
  Description of Artificial Sequence:  Enzymatic Nucleic Acid
acaatgcaggctagctacaacgattgcaggc

SEQ ID NO: 19974 - DNA, 31 bp, Artificial Sequence
  Description of Artificial Sequence:  Enzymatic Nucleic Acid
acacaatgggctagctacaacgaatttgcag

SEQ ID NO: 19975 - DNA, 31 bp, Artificial Sequence
  Description of Artificial Sequence:  Enzymatic Nucleic Acid
aaacacaaggctagctacaacgagcatttgc

SEQ ID NO: 19976 - DNA, 31 bp, Artificial Sequence
  Description of Artificial Sequence:  Enzymatic Nucleic Acid
agcaaacaggctagctacaacgaaatgcatt

SEQ ID NO: 19977 - DNA, 31 bp, Artificial Sequence
  Description of Artificial Sequence:  Enzymatic Nucleic Acid
agagcaaaggctagctacaacgaacaatgca

SEQ ID NO: 19978 - DNA, 31 bp, Artificial Sequence
  Description of Artificial Sequence:  Enzymatic Nucleic Acid
caccagagggctagctacaacgaaaacacaa

SEQ ID NO: 19979 - DNA, 31 bp, Artificial Sequence
  Description of Artificial Sequence:  Enzymatic Nucleic Acid
cacctccaggctagctacaacgacagagcaa

SEQ ID NO: 19980 - DNA, 31 bp, Artificial Sequence
  Description of Artificial Sequence:  Enzymatic Nucleic Acid
catgcccaggctagctacaacgactccacca

SEQ ID NO: 19981 - DNA, 31 bp, Artificial Sequence
  Description of Artificial Sequence:  Enzymatic Nucleic Acid
accccatgggctagctacaacgaccacctcc

SEQ ID NO: 19982 - DNA, 31 bp, Artificial Sequence
  Description of Artificial Sequence:  Enzymatic Nucleic Acid
agaccccaggctagctacaacgagcccacct

SEQ ID NO: 19983 - DNA, 31 bp, Artificial Sequence
  Description of Artificial Sequence:  Enzymatic Nucleic Acid
agaacagaggctagctacaacgacccatgcc

SEQ ID NO: 19984 - DNA, 31 bp, Artificial Sequence
  Description of Artificial Sequence:  Enzymatic Nucleic Acid
tttcagaaggctagctacaacgaagacccca

SEQ ID NO: 19985 - DNA, 31 bp, Artificial Sequence
  Description of Artificial Sequence:  Enzymatic Nucleic Acid
cctttacaggctagctacaacgattcagaac

SEQ ID NO: 19986 - DNA, 31 bp, Artificial Sequence
  Description of Artificial Sequence:  Enzymatic Nucleic Acid
accctttaggctagctacaacgaatttcaga

SEQ ID NO: 19987 - DNA, 31 bp, Artificial Sequence
  Description of Artificial Sequence:  Enzymatic Nucleic Acid
cgtctgaaggctagctacaacgacctttaca

SEQ ID NO: 19988 - DNA, 31 bp, Artificial Sequence
  Description of Artificial Sequence:  Enzymatic Nucleic Acid
aaaccccgggctagctacaacgactgaaccc

SEQ ID NO: 19989 - DNA, 31 bp, Artificial Sequence
  Description of Artificial Sequence:  Enzymatic Nucleic Acid
accagaaaggctagctacaacgacccgtctg

SEQ ID NO: 19990 - DNA, 31 bp, Artificial Sequence
  Description of Artificial Sequence:  Enzymatic Nucleic Acid
ttctaaaaggctagctacaacgacagaaacc

SEQ ID NO: 19991 - DNA, 31 bp, Artificial Sequence
  Description of Artificial Sequence:  Enzymatic Nucleic Acid
acacgcaaggctagctacaacgacttctaaa

SEQ ID NO: 19992 - DNA, 31 bp, Artificial Sequence
  Description of Artificial Sequence:  Enzymatic Nucleic Acid
agaacacgggctagctacaacgaaaccttct

SEQ ID NO: 19993 - DNA, 31 bp, Artificial Sequence
  Description of Artificial Sequence:  Enzymatic Nucleic Acid
gaagaacaggctagctacaacgagcaacctt

SEQ ID NO: 19994 - DNA, 31 bp, Artificial Sequence
  Description of Artificial Sequence:  Enzymatic Nucleic Acid
tcgaagaaggctagctacaacgaacgcaacc

SEQ ID NO: 19995 - DNA, 31 bp, Artificial Sequence
  Description of Artificial Sequence:  Enzymatic Nucleic Acid
tagcccaaggctagctacaacgatcgaagaa

SEQ ID NO: 19996 - DNA, 31 bp, Artificial Sequence
  Description of Artificial Sequence:  Enzymatic Nucleic Acid
tactttagggctagctacaacgaccaactcg

SEQ ID NO: 19997 - DNA, 31 bp, Artificial Sequence
  Description of Artificial Sequence:  Enzymatic Nucleic Acid
gaactctaggctagctacaacgatttagccc

SEQ ID NO: 19998 - DNA, 31 bp, Artificial Sequence
  Description of Artificial Sequence:  Enzymatic Nucleic Acid
acaacgaaggctagctacaacgatctacttt

SEQ ID NO: 19999 - DNA, 31 bp, Artificial Sequence
  Description of Artificial Sequence:  Enzymatic Nucleic Acid
cagcacaaggctagctacaacgagaactcta

SEQ ID NO: 20000 - DNA, 31 bp, Artificial Sequence
  Description of Artificial Sequence:  Enzymatic Nucleic Acid
aaacagcaggctagctacaacgaaacgaact

SEQ ID NO: 20001 - DNA, 31 bp, Artificial Sequence
  Description of Artificial Sequence:  Enzymatic Nucleic Acid
agaaacagggctagctacaacgaacaacgaa

SEQ ID NO: 20002 - DNA, 31 bp, Artificial Sequence
  Description of Artificial Sequence:  Enzymatic Nucleic Acid
gtcagaaaggctagctacaacgaagcacaac

SEQ ID NO: 20003 - DNA, 31 bp, Artificial Sequence
  Description of Artificial Sequence:  Enzymatic Nucleic Acid
attaggagggctagctacaacgacagaaaca

SEQ ID NO: 20004 - DNA, 31 bp, Artificial Sequence
  Description of Artificial Sequence:  Enzymatic Nucleic Acid
aactctcaggctagctacaacgataggagtc

SEQ ID NO: 20005 - DNA, 31 bp, Artificial Sequence
  Description of Artificial Sequence:  Enzymatic Nucleic Acid
ggaaggaaggctagctacaacgatctcatta

SEQ ID NO: 20006 - DNA, 31 bp, Artificial Sequence
  Description of Artificial Sequence:  Enzymatic Nucleic Acid
gctaacggggctagctacaacgactggaagg

SEQ ID NO: 20007 - DNA, 31 bp, Artificial Sequence
  Description of Artificial Sequence:  Enzymatic Nucleic Acid
acagctaaggctagctacaacgaggtctgga

SEQ ID NO: 20008 - DNA, 31 bp, Artificial Sequence
  Description of Artificial Sequence:  Enzymatic Nucleic Acid
ggagacagggctagctacaacgataacggtc

SEQ ID NO: 20009 - DNA, 31 bp, Artificial Sequence
  Description of Artificial Sequence:  Enzymatic Nucleic Acid
caaggagaggctagctacaacgaagctaacg

SEQ ID NO: 20010 - DNA, 31 bp, Artificial Sequence
  Description of Artificial Sequence:  Enzymatic Nucleic Acid
gggcttggggctagctacaacgaaaggagac

SEQ ID NO: 20011 - DNA, 31 bp, Artificial Sequence
  Description of Artificial Sequence:  Enzymatic Nucleic Acid
tcctggggggctagctacaacgattggcaag

SEQ ID NO: 20012 - DNA, 31 bp, Artificial Sequence
  Description of Artificial Sequence:  Enzymatic Nucleic Acid
ctgcatcaggctagctacaacgatttcttcc

SEQ ID NO: 20013 - DNA, 31 bp, Artificial Sequence
  Description of Artificial Sequence:  Enzymatic Nucleic Acid
gagctgcaggctagctacaacgacattttct

SEQ ID NO: 20014 - DNA, 31 bp, Artificial Sequence
  Description of Artificial Sequence:  Enzymatic Nucleic Acid
cagagctgggctagctacaacgaatcatttt

SEQ ID NO: 20015 - DNA, 31 bp, Artificial Sequence
  Description of Artificial Sequence:  Enzymatic Nucleic Acid
agccagagggctagctacaacgatgcatcat

SEQ ID NO: 20016 - DNA, 31 bp, Artificial Sequence
  Description of Artificial Sequence:  Enzymatic Nucleic Acid
acaaggagggctagctacaacgacagagctg

SEQ ID NO: 20017 - DNA, 31 bp, Artificial Sequence
  Description of Artificial Sequence:  Enzymatic Nucleic Acid
ctgggagaggctagctacaacgaaaggagcc

SEQ ID NO: 20018 - DNA, 31 bp, Artificial Sequence
  Description of Artificial Sequence:  Enzymatic Nucleic Acid
aggatcagggctagctacaacgactgggaga

SEQ ID NO: 20019 - DNA, 31 bp, Artificial Sequence
  Description of Artificial Sequence:  Enzymatic Nucleic Acid
ataaaggaggctagctacaacgacagcctgg

SEQ ID NO: 20020 - DNA, 31 bp, Artificial Sequence
  Description of Artificial Sequence:  Enzymatic Nucleic Acid
attctgaaggctagctacaacgaaaaggatc

SEQ ID NO: 20021 - DNA, 31 bp, Artificial Sequence
  Description of Artificial Sequence:  Enzymatic Nucleic Acid
ttgtggtaggctagctacaacgatctgaata

SEQ ID NO: 20022 - DNA, 31 bp, Artificial Sequence
  Description of Artificial Sequence:  Enzymatic Nucleic Acid
ctttgtggggctagctacaacgaattctgaa

SEQ ID NO: 20023 - DNA, 31 bp, Artificial Sequence
  Description of Artificial Sequence:  Enzymatic Nucleic Acid
tttctttgggctagctacaacgaggtattct

SEQ ID NO: 20024 - DNA, 31 bp, Artificial Sequence
  Description of Artificial Sequence:  Enzymatic Nucleic Acid
gctgaatgggctagctacaacgacctttctt

SEQ ID NO: 20025 - DNA, 31 bp, Artificial Sequence
  Description of Artificial Sequence:  Enzymatic Nucleic Acid
gagctgaaggctagctacaacgagtcctttc

SEQ ID NO: 20026 - DNA, 31 bp, Artificial Sequence
  Description of Artificial Sequence:  Enzymatic Nucleic Acid
gccttgagggctagctacaacgatgaatgtc

SEQ ID NO: 20027 - DNA, 31 bp, Artificial Sequence
  Description of Artificial Sequence:  Enzymatic Nucleic Acid
gcagggagggctagctacaacgacttgagct

SEQ ID NO: 20028 - DNA, 31 bp, Artificial Sequence
  Description of Artificial Sequence:  Enzymatic Nucleic Acid
caacacggggctagctacaacgaagggagcc

SEQ ID NO: 20029 - DNA, 31 bp, Artificial Sequence
  Description of Artificial Sequence:  Enzymatic Nucleic Acid
cttcaacaggctagctacaacgaggcaggga

SEQ ID NO: 20030 - DNA, 31 bp, Artificial Sequence
  Description of Artificial Sequence:  Enzymatic Nucleic Acid
ctcttcaaggctagctacaacgaacggcagg

SEQ ID NO: 20031 - DNA, 31 bp, Artificial Sequence
  Description of Artificial Sequence:  Enzymatic Nucleic Acid
agtcagaaggctagctacaacgatcttcaac

SEQ ID NO: 20032 - DNA, 31 bp, Artificial Sequence
  Description of Artificial Sequence:  Enzymatic Nucleic Acid
ttgtgcagggctagctacaacgacagaactc

SEQ ID NO: 20033 - DNA, 31 bp, Artificial Sequence
  Description of Artificial Sequence:  Enzymatic Nucleic Acid
ggtttgtgggctagctacaacgaagtcagaa

SEQ ID NO: 20034 - DNA, 31 bp, Artificial Sequence
  Description of Artificial Sequence:  Enzymatic Nucleic Acid
ctggtttgggctagctacaacgagcagtcag

SEQ ID NO: 20035 - DNA, 31 bp, Artificial Sequence
  Description of Artificial Sequence:  Enzymatic Nucleic Acid
gaagctggggctagctacaacgattgtgcag

SEQ ID NO: 20036 - DNA, 31 bp, Artificial Sequence
  Description of Artificial Sequence:  Enzymatic Nucleic Acid
accagaagggctagctacaacgatggtttgt

SEQ ID NO: 20037 - DNA, 31 bp, Artificial Sequence
  Description of Artificial Sequence:  Enzymatic Nucleic Acid
agaagaaaggctagctacaacgacagaagct

SEQ ID NO: 20038 - DNA, 31 bp, Artificial Sequence
  Description of Artificial Sequence:  Enzymatic Nucleic Acid
ggtattcaggctagctacaacgatccagaag

SEQ ID NO: 20039 - DNA, 31 bp, Artificial Sequence
  Description of Artificial Sequence:  Enzymatic Nucleic Acid
tgagggtaggctagctacaacgatcattcca

SEQ ID NO: 20040 - DNA, 31 bp, Artificial Sequence
  Description of Artificial Sequence:  Enzymatic Nucleic Acid
tatgagggggctagctacaacgaattcattc

SEQ ID NO: 20041 - DNA, 31 bp, Artificial Sequence
  Description of Artificial Sequence:  Enzymatic Nucleic Acid
gacagataggctagctacaacgagagggtat

SEQ ID NO: 20042 - DNA, 31 bp, Artificial Sequence
  Description of Artificial Sequence:  Enzymatic Nucleic Acid
aggacagaggctagctacaacgaatgagggt

SEQ ID NO: 20043 - DNA, 31 bp, Artificial Sequence
  Description of Artificial Sequence:  Enzymatic Nucleic Acid
catcaggaggctagctacaacgaagatatga

SEQ ID NO: 20044 - DNA, 31 bp, Artificial Sequence
  Description of Artificial Sequence:  Enzymatic Nucleic Acid
atatcacaggctagctacaacgacaggacag

SEQ ID NO: 20045 - DNA, 31 bp, Artificial Sequence
  Description of Artificial Sequence:  Enzymatic Nucleic Acid
acatatcaggctagctacaacgaatcaggac

SEQ ID NO: 20046 - DNA, 31 bp, Artificial Sequence
  Description of Artificial Sequence:  Enzymatic Nucleic Acid
cagacataggctagctacaacgacacatcag

SEQ ID NO: 20047 - DNA, 31 bp, Artificial Sequence
  Description of Artificial Sequence:  Enzymatic Nucleic Acid
ctcagacaggctagctacaacgaatcacatc

SEQ ID NO: 20048 - DNA, 31 bp, Artificial Sequence
  Description of Artificial Sequence:  Enzymatic Nucleic Acid
gtctcagaggctagctacaacgaatatcaca

SEQ ID NO: 20049 - DNA, 31 bp, Artificial Sequence
  Description of Artificial Sequence:  Enzymatic Nucleic Acid
gcattcagggctagctacaacgactcagaca

SEQ ID NO: 20050 - DNA, 31 bp, Artificial Sequence
  Description of Artificial Sequence:  Enzymatic Nucleic Acid
ctcccgcaggctagctacaacgatcagtctc

SEQ ID NO: 20051 - DNA, 31 bp, Artificial Sequence
  Description of Artificial Sequence:  Enzymatic Nucleic Acid
acctcccgggctagctacaacgaattcagtc

SEQ ID NO: 20052 - DNA, 31 bp, Artificial Sequence
  Description of Artificial Sequence:  Enzymatic Nucleic Acid
acattgaaggctagctacaacgactcccgca

SEQ ID NO: 20053 - DNA, 31 bp, Artificial Sequence
  Description of Artificial Sequence:  Enzymatic Nucleic Acid
gcttcacaggctagctacaacgatgaacctc

SEQ ID NO: 20054 - DNA, 31 bp, Artificial Sequence
  Description of Artificial Sequence:  Enzymatic Nucleic Acid
cagcttcaggctagctacaacgaattgaacc

SEQ ID NO: 20055 - DNA, 31 bp, Artificial Sequence
  Description of Artificial Sequence:  Enzymatic Nucleic Acid
acacacagggctagctacaacgattcacatt

SEQ ID NO: 20056 - DNA, 31 bp, Artificial Sequence
  Description of Artificial Sequence:  Enzymatic Nucleic Acid
accacacaggctagctacaacgaagcttcac

SEQ ID NO: 20057 - DNA, 31 bp, Artificial Sequence
  Description of Artificial Sequence:  Enzymatic Nucleic Acid
acaccacaggctagctacaacgaacagcttc

SEQ ID NO: 20058 - DNA, 31 bp, Artificial Sequence
  Description of Artificial Sequence:  Enzymatic Nucleic Acid
tgacaccaggctagctacaacgaacacagct

SEQ ID NO: 20059 - DNA, 31 bp, Artificial Sequence
  Description of Artificial Sequence:  Enzymatic Nucleic Acid
ctttgacaggctagctacaacgacacacaca

SEQ ID NO: 20060 - DNA, 31 bp, Artificial Sequence
  Description of Artificial Sequence:  Enzymatic Nucleic Acid
aactttgaggctagctacaacgaaccacaca

SEQ ID NO: 20061 - DNA, 31 bp, Artificial Sequence
  Description of Artificial Sequence:  Enzymatic Nucleic Acid
tcctgaaaggctagctacaacgatttgacac

SEQ ID NO: 20062 - DNA, 31 bp, Artificial Sequence
  Description of Artificial Sequence:  Enzymatic Nucleic Acid
gggtaaaaggctagctacaacgaccttcctg

SEQ ID NO: 20063 - DNA, 31 bp, Artificial Sequence
  Description of Artificial Sequence:  Enzymatic Nucleic Acid
caaaagggggctagctacaacgaaaaatcct

SEQ ID NO: 20064 - DNA, 31 bp, Artificial Sequence
  Description of Artificial Sequence:  Enzymatic Nucleic Acid
gggaagaaggctagctacaacgaaaaagggt

SEQ ID NO: 20065 - DNA, 31 bp, Artificial Sequence
  Description of Artificial Sequence:  Enzymatic Nucleic Acid
gttggggaggctagctacaacgaagggggaa

SEQ ID NO: 20066 - DNA, 31 bp, Artificial Sequence
  Description of Artificial Sequence:  Enzymatic Nucleic Acid
agagtgggggctagctacaacgatggggaca

SEQ ID NO: 20067 - DNA, 31 bp, Artificial Sequence
  Description of Artificial Sequence:  Enzymatic Nucleic Acid
ggtgagagggctagctacaacgagggttggg

SEQ ID NO: 20068 - DNA, 31 bp, Artificial Sequence
  Description of Artificial Sequence:  Enzymatic Nucleic Acid
ttgcggggggctagctacaacgagagagtgg

SEQ ID NO: 20069 - DNA, 31 bp, Artificial Sequence
  Description of Artificial Sequence:  Enzymatic Nucleic Acid
atgggttgggctagctacaacgaggggtgag

SEQ ID NO: 20070 - DNA, 31 bp, Artificial Sequence
  Description of Artificial Sequence:  Enzymatic Nucleic Acid
ctgatgggggctagctacaacgatgcggggt

SEQ ID NO: 20071 - DNA, 31 bp, Artificial Sequence
  Description of Artificial Sequence:  Enzymatic Nucleic Acid
aatactgaggctagctacaacgagggttgcg

SEQ ID NO: 20072 - DNA, 31 bp, Artificial Sequence
  Description of Artificial Sequence:  Enzymatic Nucleic Acid
ctaaaataggctagctacaacgatgatgggt

SEQ ID NO: 20073 - DNA, 31 bp, Artificial Sequence
  Description of Artificial Sequence:  Enzymatic Nucleic Acid
aactaaaaggctagctacaacgaactgatgg

SEQ ID NO: 20074 - DNA, 31 bp, Artificial Sequence
  Description of Artificial Sequence:  Enzymatic Nucleic Acid
ccaaataaggctagctacaacgataaaatac

SEQ ID NO: 20075 - DNA, 31 bp, Artificial Sequence
  Description of Artificial Sequence:  Enzymatic Nucleic Acid
aggccaaaggctagctacaacgaaactaaaa

SEQ ID NO: 20076 - DNA, 31 bp, Artificial Sequence
  Description of Artificial Sequence:  Enzymatic Nucleic Acid
agtagaggggctagctacaacgacaaataac

SEQ ID NO: 20077 - DNA, 31 bp, Artificial Sequence
  Description of Artificial Sequence:  Enzymatic Nucleic Acid
tactggagggctagctacaacgaagaggcca

SEQ ID NO: 20078 - DNA, 31 bp, Artificial Sequence
  Description of Artificial Sequence:  Enzymatic Nucleic Acid
caggtttaggctagctacaacgatggagtag

SEQ ID NO: 20079 - DNA, 31 bp, Artificial Sequence
  Description of Artificial Sequence:  Enzymatic Nucleic Acid
caatcaggggctagctacaacgattactgga

SEQ ID NO: 20080 - DNA, 31 bp, Artificial Sequence
  Description of Artificial Sequence:  Enzymatic Nucleic Acid
aaacccaaggctagctacaacgacaggttta

SEQ ID NO: 20081 - DNA, 31 bp, Artificial Sequence
  Description of Artificial Sequence:  Enzymatic Nucleic Acid
tgaacaaaggctagctacaacgaccaatcag

SEQ ID NO: 20082 - DNA, 31 bp, Artificial Sequence
  Description of Artificial Sequence:  Enzymatic Nucleic Acid
agagtgaaggctagctacaacgaaaacccaa

SEQ ID NO: 20083 - DNA, 31 bp, Artificial Sequence
  Description of Artificial Sequence:  Enzymatic Nucleic Acid
tcagagagggctagctacaacgagaacaaac

SEQ ID NO: 20084 - DNA, 31 bp, Artificial Sequence
  Description of Artificial Sequence:  Enzymatic Nucleic Acid
aataatcaggctagctacaacgatcagagag

SEQ ID NO: 20085 - DNA, 31 bp, Artificial Sequence
  Description of Artificial Sequence:  Enzymatic Nucleic Acid
gctaataaggctagctacaacgacattcaga

SEQ ID NO: 20086 - DNA, 31 bp, Artificial Sequence
  Description of Artificial Sequence:  Enzymatic Nucleic Acid
ctggctaaggctagctacaacgaaatcattc

SEQ ID NO: 20087 - DNA, 31 bp, Artificial Sequence
  Description of Artificial Sequence:  Enzymatic Nucleic Acid
aagtctggggctagctacaacgataataatc

SEQ ID NO: 20088 - DNA, 31 bp, Artificial Sequence
  Description of Artificial Sequence:  Enzymatic Nucleic Acid
ttttgaagggctagctacaacgactggctaa

SEQ ID NO: 20089 - DNA, 31 bp, Artificial Sequence
  Description of Artificial Sequence:  Enzymatic Nucleic Acid
taaaataaggctagctacaacgatttgaagt

SEQ ID NO: 20090 - DNA, 31 bp, Artificial Sequence
  Description of Artificial Sequence:  Enzymatic Nucleic Acid
ctataaaaggctagctacaacgaaattttga

SEQ ID NO: 20091 - DNA, 31 bp, Artificial Sequence
  Description of Artificial Sequence:  Enzymatic Nucleic Acid
ttgggctaggctagctacaacgaaaaataat

SEQ ID NO: 20092 - DNA, 31 bp, Artificial Sequence
  Description of Artificial Sequence:  Enzymatic Nucleic Acid
aatttgggggctagctacaacgatataaaat

SEQ ID NO: 20093 - DNA, 31 bp, Artificial Sequence
  Description of Artificial Sequence:  Enzymatic Nucleic Acid
tgttataaggctagctacaacgattgggcta

SEQ ID NO: 20094 - DNA, 31 bp, Artificial Sequence
  Description of Artificial Sequence:  Enzymatic Nucleic Acid
agatgttaggctagctacaacgaaatttggg

SEQ ID NO: 20095 - DNA, 31 bp, Artificial Sequence
  Description of Artificial Sequence:  Enzymatic Nucleic Acid
aatagatgggctagctacaacgatataattt

SEQ ID NO: 20096 - DNA, 31 bp, Artificial Sequence
  Description of Artificial Sequence:  Enzymatic Nucleic Acid
acaatagaggctagctacaacgagttataat

SEQ ID NO: 20097 - DNA, 31 bp, Artificial Sequence
  Description of Artificial Sequence:  Enzymatic Nucleic Acid
taatacaaggctagctacaacgaagatgtta

SEQ ID NO: 20098 - DNA, 31 bp, Artificial Sequence
  Description of Artificial Sequence:  Enzymatic Nucleic Acid
aaataataggctagctacaacgaaatagatg

SEQ ID NO: 20099 - DNA, 31 bp, Artificial Sequence
  Description of Artificial Sequence:  Enzymatic Nucleic Acid
ctaaataaggctagctacaacgaacaataga

SEQ ID NO: 20100 - DNA, 31 bp, Artificial Sequence
  Description of Artificial Sequence:  Enzymatic Nucleic Acid
agtctaaaggctagctacaacgaaatacaat

SEQ ID NO: 20101 - DNA, 31 bp, Artificial Sequence
  Description of Artificial Sequence:  Enzymatic Nucleic Acid
gttaaaagggctagctacaacgactaaataa

SEQ ID NO: 20102 - DNA, 31 bp, Artificial Sequence
  Description of Artificial Sequence:  Enzymatic Nucleic Acid
tctatatgggctagctacaacgataaaagtc

SEQ ID NO: 20103 - DNA, 31 bp, Artificial Sequence
  Description of Artificial Sequence:  Enzymatic Nucleic Acid
gctctataggctagctacaacgagttaaaag

SEQ ID NO: 20104 - DNA, 31 bp, Artificial Sequence
  Description of Artificial Sequence:  Enzymatic Nucleic Acid
tagctctaggctagctacaacgaatgttaaa

SEQ ID NO: 20105 - DNA, 31 bp, Artificial Sequence
  Description of Artificial Sequence:  Enzymatic Nucleic Acid
agaaatagggctagctacaacgatctatatg

SEQ ID NO: 20106 - DNA, 31 bp, Artificial Sequence
  Description of Artificial Sequence:  Enzymatic Nucleic Acid
agtagaaaggctagctacaacgaagctctat

SEQ ID NO: 20107 - DNA, 31 bp, Artificial Sequence
  Description of Artificial Sequence:  Enzymatic Nucleic Acid
aaaatcagggctagctacaacgaagaaatag

SEQ ID NO: 20108 - DNA, 31 bp, Artificial Sequence
  Description of Artificial Sequence:  Enzymatic Nucleic Acid
ggcaaaaaggctagctacaacgacagtagaa

SEQ ID NO: 20109 - DNA, 31 bp, Artificial Sequence
  Description of Artificial Sequence:  Enzymatic Nucleic Acid
aacaagggggctagctacaacgaaaaaatca

SEQ ID NO: 20110 - DNA, 31 bp, Artificial Sequence
  Description of Artificial Sequence:  Enzymatic Nucleic Acid
ggacagaaggctagctacaacgaaagggcaa

SEQ ID NO: 20111 - DNA, 31 bp, Artificial Sequence
  Description of Artificial Sequence:  Enzymatic Nucleic Acid
aaaaaggaggctagctacaacgaagaacaag

SEQ ID NO: 20112 - DNA, 31 bp, Artificial Sequence
  Description of Artificial Sequence:  Enzymatic Nucleic Acid
aaaacacaggctagctacaacgatttctttt

SEQ ID NO: 20113 - DNA, 31 bp, Artificial Sequence
  Description of Artificial Sequence:  Enzymatic Nucleic Acid
aaaaaacaggctagctacaacgaattttctt

SEQ ID NO: 20114 - DNA, 31 bp, Artificial Sequence
  Description of Artificial Sequence:  Enzymatic Nucleic Acid
acaaaaaaggctagctacaacgaacattttc

SEQ ID NO: 20115 - DNA, 31 bp, Artificial Sequence
  Description of Artificial Sequence:  Enzymatic Nucleic Acid
gtaccaaaggctagctacaacgaaaaaaaca

SEQ ID NO: 20116 - DNA, 31 bp, Artificial Sequence
  Description of Artificial Sequence:  Enzymatic Nucleic Acid
ctatggtaggctagctacaacgacaaacaaa

SEQ ID NO: 20117 - DNA, 31 bp, Artificial Sequence
  Description of Artificial Sequence:  Enzymatic Nucleic Acid
cactatggggctagctacaacgaaccaaaca

SEQ ID NO: 20118 - DNA, 31 bp, Artificial Sequence
  Description of Artificial Sequence:  Enzymatic Nucleic Acid
tcacactaggctagctacaacgaggtaccaa

SEQ ID NO: 20119 - DNA, 31 bp, Artificial Sequence
  Description of Artificial Sequence:  Enzymatic Nucleic Acid
atttcacaggctagctacaacgatatggtac

SEQ ID NO: 20120 - DNA, 31 bp, Artificial Sequence
  Description of Artificial Sequence:  Enzymatic Nucleic Acid
gcatttcaggctagctacaacgaactatggt

SEQ ID NO: 20121 - DNA, 31 bp, Artificial Sequence
  Description of Artificial Sequence:  Enzymatic Nucleic Acid
tcccagcaggctagctacaacgattcacact

SEQ ID NO: 20122 - DNA, 31 bp, Artificial Sequence
  Description of Artificial Sequence:  Enzymatic Nucleic Acid
gttcccagggctagctacaacgaatttcaca

SEQ ID NO: 20123 - DNA, 31 bp, Artificial Sequence
  Description of Artificial Sequence:  Enzymatic Nucleic Acid
agtcattgggctagctacaacgatcccagca

SEQ ID NO: 20124 - DNA, 31 bp, Artificial Sequence
  Description of Artificial Sequence:  Enzymatic Nucleic Acid
tatagtcaggctagctacaacgatgttccca

SEQ ID NO: 20125 - DNA, 31 bp, Artificial Sequence
  Description of Artificial Sequence:  Enzymatic Nucleic Acid
tcttatagggctagctacaacgacattgttc

SEQ ID NO: 20126 - DNA, 31 bp, Artificial Sequence
  Description of Artificial Sequence:  Enzymatic Nucleic Acid
atgtcttaggctagctacaacgaagtcattg

SEQ ID NO: 20127 - DNA, 31 bp, Artificial Sequence
  Description of Artificial Sequence:  Enzymatic Nucleic Acid
atagcatgggctagctacaacgacttatagt

SEQ ID NO: 20128 - DNA, 31 bp, Artificial Sequence
  Description of Artificial Sequence:  Enzymatic Nucleic Acid
ccatagcaggctagctacaacgagtcttata

SEQ ID NO: 20129 - DNA, 31 bp, Artificial Sequence
  Description of Artificial Sequence:  Enzymatic Nucleic Acid
tgccatagggctagctacaacgaatgtctta

SEQ ID NO: 20130 - DNA, 31 bp, Artificial Sequence
  Description of Artificial Sequence:  Enzymatic Nucleic Acid
atgtgccaggctagctacaacgaagcatgtc

SEQ ID NO: 20131 - DNA, 31 bp, Artificial Sequence
  Description of Artificial Sequence:  Enzymatic Nucleic Acid
tatatgtgggctagctacaacgacatagcat

SEQ ID NO: 20132 - DNA, 31 bp, Artificial Sequence
  Description of Artificial Sequence:  Enzymatic Nucleic Acid
aatatatgggctagctacaacgagccatagc

SEQ ID NO: 20133 - DNA, 31 bp, Artificial Sequence
  Description of Artificial Sequence:  Enzymatic Nucleic Acid
taaatataggctagctacaacgagtgccata

SEQ ID NO: 20134 - DNA, 31 bp, Artificial Sequence
  Description of Artificial Sequence:  Enzymatic Nucleic Acid
tataaataggctagctacaacgaatgtgcca

SEQ ID NO: 20135 - DNA, 31 bp, Artificial Sequence
  Description of Artificial Sequence:  Enzymatic Nucleic Acid
actataaaggctagctacaacgaatatgtgc

SEQ ID NO: 20136 - DNA, 31 bp, Artificial Sequence
  Description of Artificial Sequence:  Enzymatic Nucleic Acid
acagactaggctagctacaacgaaaatatat

SEQ ID NO: 20137 - DNA, 31 bp, Artificial Sequence
  Description of Artificial Sequence:  Enzymatic Nucleic Acid
taaacagaggctagctacaacgatataaata

SEQ ID NO: 20138 - DNA, 31 bp, Artificial Sequence
  Description of Artificial Sequence:  Enzymatic Nucleic Acid
tacataaaggctagctacaacgaagactata

SEQ ID NO: 20139 - DNA, 31 bp, Artificial Sequence
  Description of Artificial Sequence:  Enzymatic Nucleic Acid
tttctacaggctagctacaacgaaaacagac

SEQ ID NO: 20140 - DNA, 31 bp, Artificial Sequence
  Description of Artificial Sequence:  Enzymatic Nucleic Acid
tgtttctaggctagctacaacgaataaacag

SEQ ID NO: 20141 - DNA, 31 bp, Artificial Sequence
  Description of Artificial Sequence:  Enzymatic Nucleic Acid
tacatttgggctagctacaacgattctacat

SEQ ID NO: 20142 - DNA, 31 bp, Artificial Sequence
  Description of Artificial Sequence:  Enzymatic Nucleic Acid
atattacaggctagctacaacgattgtttct

SEQ ID NO: 20143 - DNA, 31 bp, Artificial Sequence
  Description of Artificial Sequence:  Enzymatic Nucleic Acid
atatattaggctagctacaacgaatttgttt

SEQ ID NO: 20144 - DNA, 31 bp, Artificial Sequence
  Description of Artificial Sequence:  Enzymatic Nucleic Acid
ttaatataggctagctacaacgatacatttg

SEQ ID NO: 20145 - DNA, 31 bp, Artificial Sequence
  Description of Artificial Sequence:  Enzymatic Nucleic Acid
ctttaataggctagctacaacgaattacatt

SEQ ID NO: 20146 - DNA, 31 bp, Artificial Sequence
  Description of Artificial Sequence:  Enzymatic Nucleic Acid
ggctttaaggctagctacaacgaatattaca

SEQ ID NO: 20147 - DNA, 31 bp, Artificial Sequence
  Description of Artificial Sequence:  Enzymatic Nucleic Acid
atataaggggctagctacaacgatttaatat

SEQ ID NO: 20148 - DNA, 31 bp, Artificial Sequence
  Description of Artificial Sequence:  Enzymatic Nucleic Acid
attatataggctagctacaacgaaaggcttt

SEQ ID NO: 20149 - DNA, 31 bp, Artificial Sequence
  Description of Artificial Sequence:  Enzymatic Nucleic Acid
tcattataggctagctacaacgaataaggct

SEQ ID NO: 20150 - DNA, 31 bp, Artificial Sequence
  Description of Artificial Sequence:  Enzymatic Nucleic Acid
gttcattaggctagctacaacgaatataagg

SEQ ID NO: 20151 - DNA, 31 bp, Artificial Sequence
  Description of Artificial Sequence:  Enzymatic Nucleic Acid
aaagttcaggctagctacaacgatatatata

SEQ ID NO: 20152 - DNA, 31 bp, Artificial Sequence
  Description of Artificial Sequence:  Enzymatic Nucleic Acid
gtacaaagggctagctacaacgatcattata

SEQ ID NO: 20153 - DNA, 31 bp, Artificial Sequence
  Description of Artificial Sequence:  Enzymatic Nucleic Acid
gaatagtaggctagctacaacgaaaagttca

SEQ ID NO: 20154 - DNA, 31 bp, Artificial Sequence
  Description of Artificial Sequence:  Enzymatic Nucleic Acid
gtgaatagggctagctacaacgaacaaagtt

SEQ ID NO: 20155 - DNA, 31 bp, Artificial Sequence
  Description of Artificial Sequence:  Enzymatic Nucleic Acid
aatgtgaaggctagctacaacgaagtacaaa

SEQ ID NO: 20156 - DNA, 31 bp, Artificial Sequence
  Description of Artificial Sequence:  Enzymatic Nucleic Acid
acaaaatgggctagctacaacgagaatagta

SEQ ID NO: 20157 - DNA, 31 bp, Artificial Sequence
  Description of Artificial Sequence:  Enzymatic Nucleic Acid
atacaaaaggctagctacaacgagtgaatag

SEQ ID NO: 20158 - DNA, 31 bp, Artificial Sequence
  Description of Artificial Sequence:  Enzymatic Nucleic Acid
tactgataggctagctacaacgaaaaatgtg

SEQ ID NO: 20159 - DNA, 31 bp, Artificial Sequence
  Description of Artificial Sequence:  Enzymatic Nucleic Acid
aatactgaggctagctacaacgaacaaaatg

SEQ ID NO: 20160 - DNA, 31 bp, Artificial Sequence
  Description of Artificial Sequence:  Enzymatic Nucleic Acid
acataataggctagctacaacgatgatacaa

SEQ ID NO: 20161 - DNA, 31 bp, Artificial Sequence
  Description of Artificial Sequence:  Enzymatic Nucleic Acid
ctacataaggctagctacaacgaactgatac

SEQ ID NO: 20162 - DNA, 31 bp, Artificial Sequence
  Description of Artificial Sequence:  Enzymatic Nucleic Acid
atgctacaggctagctacaacgaaatactga

SEQ ID NO: 20163 - DNA, 31 bp, Artificial Sequence
  Description of Artificial Sequence:  Enzymatic Nucleic Acid
ttatgctaggctagctacaacgaataatact

SEQ ID NO: 20164 - DNA, 31 bp, Artificial Sequence
  Description of Artificial Sequence:  Enzymatic Nucleic Acid
ttgttatgggctagctacaacgatacataat

SEQ ID NO: 20165 - DNA, 31 bp, Artificial Sequence
  Description of Artificial Sequence:  Enzymatic Nucleic Acid
ctttgttaggctagctacaacgagctacata

SEQ ID NO: 20166 - DNA, 31 bp, Artificial Sequence
  Description of Artificial Sequence:  Enzymatic Nucleic Acid
gacctttgggctagctacaacgatatgctac

SEQ ID NO: 20167 - DNA, 31 bp, Artificial Sequence
  Description of Artificial Sequence:  Enzymatic Nucleic Acid
cattatgaggctagctacaacgactttgtta

SEQ ID NO: 20168 - DNA, 31 bp, Artificial Sequence
  Description of Artificial Sequence:  Enzymatic Nucleic Acid
aagcattaggctagctacaacgagacctttg

SEQ ID NO: 20169 - DNA, 31 bp, Artificial Sequence
  Description of Artificial Sequence:  Enzymatic Nucleic Acid
tgaaagcaggctagctacaacgatatgacct

SEQ ID NO: 20170 - DNA, 31 bp, Artificial Sequence
  Description of Artificial Sequence:  Enzymatic Nucleic Acid
gctgaaagggctagctacaacgaattatgac

SEQ ID NO: 20171 - DNA, 31 bp, Artificial Sequence
  Description of Artificial Sequence:  Enzymatic Nucleic Acid
atcaattgggctagctacaacgatgaaagca

SEQ ID NO: 20172 - DNA, 31 bp, Artificial Sequence
  Description of Artificial Sequence:  Enzymatic Nucleic Acid
gacatcaaggctagctacaacgatgctgaaa

SEQ ID NO: 20173 - DNA, 31 bp, Artificial Sequence
  Description of Artificial Sequence:  Enzymatic Nucleic Acid
aaatgacaggctagctacaacgacaattgct

SEQ ID NO: 20174 - DNA, 31 bp, Artificial Sequence
  Description of Artificial Sequence:  Enzymatic Nucleic Acid
taaaatgaggctagctacaacgaatcaattg

SEQ ID NO: 20175 - DNA, 31 bp, Artificial Sequence
  Description of Artificial Sequence:  Enzymatic Nucleic Acid
taataaaaggctagctacaacgagacatcaa

SEQ ID NO: 20176 - DNA, 31 bp, Artificial Sequence
  Description of Artificial Sequence:  Enzymatic Nucleic Acid
ttctttaaggctagctacaacgaaaaatgac

SEQ ID NO: 20177 - DNA, 31 bp, Artificial Sequence
  Description of Artificial Sequence:  Enzymatic Nucleic Acid
tttcaatgggctagctacaacgatctttaat

SEQ ID NO: 20178 - DNA, 31 bp, Artificial Sequence
  Description of Artificial Sequence:  Enzymatic Nucleic Acid
tttttcaaggctagctacaacgagttcttta

SEQ ID NO: 20179 - RNA, 37 nt, Artificial Sequence
  Description of Artificial Sequence:  Enzymatic Nucleic Acid
acugaccggccgaaaggcgagugaggucuucucccgg

SEQ ID NO: 20180 - RNA, 37 nt, Artificial Sequence
  Description of Artificial Sequence:  Enzymatic Nucleic Acid
cacacugagccgaaaggcgagugaggucucgcucucc

SEQ ID NO: 20181 - RNA, 37 nt, Artificial Sequence
  Description of Artificial Sequence:  Enzymatic Nucleic Acid
accacacagccgaaaggcgagugaggucuugaccgcu

SEQ ID NO: 20182 - RNA, 37 nt, Artificial Sequence
  Description of Artificial Sequence:  Enzymatic Nucleic Acid
cgaccacagccgaaaggcgagugaggucuacugaccg

SEQ ID NO: 20183 - RNA, 37 nt, Artificial Sequence
  Description of Artificial Sequence:  Enzymatic Nucleic Acid
agcgaccagccgaaaggcgagugaggucuacacugac

SEQ ID NO: 20184 - RNA, 37 nt, Artificial Sequence
  Description of Artificial Sequence:  Enzymatic Nucleic Acid
cgcagcgagccgaaaggcgagugaggucucacacacu

SEQ ID NO: 20185 - RNA, 37 nt, Artificial Sequence
  Description of Artificial Sequence:  Enzymatic Nucleic Acid
aaacgcaggccgaaaggcgagugaggucugaccacac

SEQ ID NO: 20186 - RNA, 37 nt, Artificial Sequence
  Description of Artificial Sequence:  Enzymatic Nucleic Acid
aggaaacggccgaaaggcgagugaggucuagcgacca

SEQ ID NO: 20187 - RNA, 37 nt, Artificial Sequence
  Description of Artificial Sequence:  Enzymatic Nucleic Acid
agaggaaagccgaaaggcgagugaggucugcagcgac

SEQ ID NO: 20188 - RNA, 37 nt, Artificial Sequence
  Description of Artificial Sequence:  Enzymatic Nucleic Acid
ggcgcagggccgaaaggcgagugaggucuagaggaaa

SEQ ID NO: 20189 - RNA, 37 nt, Artificial Sequence
  Description of Artificial Sequence:  Enzymatic Nucleic Acid
gcccggcggccgaaaggcgagugaggucuaggcagag

SEQ ID NO: 20190 - RNA, 37 nt, Artificial Sequence
  Description of Artificial Sequence:  Enzymatic Nucleic Acid
augcccgggccgaaaggcgagugaggucugcaggcag

SEQ ID NO: 20191 - RNA, 37 nt, Artificial Sequence
  Description of Artificial Sequence:  Enzymatic Nucleic Acid
aagugauggccgaaaggcgagugaggucuccggcgca

SEQ ID NO: 20192 - RNA, 37 nt, Artificial Sequence
  Description of Artificial Sequence:  Enzymatic Nucleic Acid
gcggcgcggccgaaaggcgagugaggucuaagugaug

SEQ ID NO: 20193 - RNA, 37 nt, Artificial Sequence
  Description of Artificial Sequence:  Enzymatic Nucleic Acid
cugcggcggccgaaaggcgagugaggucugcaaguga

SEQ ID NO: 20194 - RNA, 37 nt, Artificial Sequence
  Description of Artificial Sequence:  Enzymatic Nucleic Acid
uucugcgggccgaaaggcgagugaggucugcgcaagu

SEQ ID NO: 20195 - RNA, 37 nt, Artificial Sequence
  Description of Artificial Sequence:  Enzymatic Nucleic Acid
acuuucuggccgaaaggcgagugaggucuggcgcgca

SEQ ID NO: 20196 - RNA, 37 nt, Artificial Sequence
  Description of Artificial Sequence:  Enzymatic Nucleic Acid
cagacggagccgaaaggcgagugaggucuuuucugcg

SEQ ID NO: 20197 - RNA, 37 nt, Artificial Sequence
  Description of Artificial Sequence:  Enzymatic Nucleic Acid
cugccagagccgaaaggcgagugaggucuggacuuuc

SEQ ID NO: 20198 - RNA, 37 nt, Artificial Sequence
  Description of Artificial Sequence:  Enzymatic Nucleic Acid
ccaggcuggccgaaaggcgagugaggucucagacgga

SEQ ID NO: 20199 - RNA, 37 nt, Artificial Sequence
  Description of Artificial Sequence:  Enzymatic Nucleic Acid
uauccagggccgaaaggcgagugaggucuugccagac

SEQ ID NO: 20200 - RNA, 37 nt, Artificial Sequence
  Description of Artificial Sequence:  Enzymatic Nucleic Acid
ugcggguggccgaaaggcgagugaggucucgguagga

SEQ ID NO: 20201 - RNA, 37 nt, Artificial Sequence
  Description of Artificial Sequence:  Enzymatic Nucleic Acid
ggcgucuggccgaaaggcgagugaggucugggugccg

SEQ ID NO: 20202 - RNA, 37 nt, Artificial Sequence
  Description of Artificial Sequence:  Enzymatic Nucleic Acid
ugcagggggccgaaaggcgagugaggucugucugcgg

SEQ ID NO: 20203 - RNA, 37 nt, Artificial Sequence
  Description of Artificial Sequence:  Enzymatic Nucleic Acid
ggcggcuggccgaaaggcgagugaggucuaggggcgu

SEQ ID NO: 20204 - RNA, 37 nt, Artificial Sequence
  Description of Artificial Sequence:  Enzymatic Nucleic Acid
accggcgggccgaaaggcgagugaggucuugcagggg

SEQ ID NO: 20205 - RNA, 37 nt, Artificial Sequence
  Description of Artificial Sequence:  Enzymatic Nucleic Acid
ccgaccgggccgaaaggcgagugaggucuggcugcag

SEQ ID NO: 20206 - RNA, 37 nt, Artificial Sequence
  Description of Artificial Sequence:  Enzymatic Nucleic Acid
ggcgccgagccgaaaggcgagugaggucucggcggcu

SEQ ID NO: 20207 - RNA, 37 nt, Artificial Sequence
  Description of Artificial Sequence:  Enzymatic Nucleic Acid
cccgggcggccgaaaggcgagugaggucucgaccggc

SEQ ID NO: 20208 - RNA, 37 nt, Artificial Sequence
  Description of Artificial Sequence:  Enzymatic Nucleic Acid
agcccggggccgaaaggcgagugaggucugccgaccg

SEQ ID NO: 20209 - RNA, 37 nt, Artificial Sequence
  Description of Artificial Sequence:  Enzymatic Nucleic Acid
cuagggaggccgaaaggcgagugaggucuccgggcgc

SEQ ID NO: 20210 - RNA, 37 nt, Artificial Sequence
  Description of Artificial Sequence:  Enzymatic Nucleic Acid
gcacaggggccgaaaggcgagugaggucuuagggagc

SEQ ID NO: 20211 - RNA, 37 nt, Artificial Sequence
  Description of Artificial Sequence:  Enzymatic Nucleic Acid
ugagcgcagccgaaaggcgagugaggucuagggcuag

SEQ ID NO: 20212 - RNA, 37 nt, Artificial Sequence
  Description of Artificial Sequence:  Enzymatic Nucleic Acid
guugagcggccgaaaggcgagugaggucuacagggcu

SEQ ID NO: 20213 - RNA, 37 nt, Artificial Sequence
  Description of Artificial Sequence:  Enzymatic Nucleic Acid
caguugaggccgaaaggcgagugaggucugcacaggg

SEQ ID NO: 20214 - RNA, 37 nt, Artificial Sequence
  Description of Artificial Sequence:  Enzymatic Nucleic Acid
gcgcaggagccgaaaggcgagugaggucuaguugagc

SEQ ID NO: 20215 - RNA, 37 nt, Artificial Sequence
  Description of Artificial Sequence:  Enzymatic Nucleic Acid
ccgcagcggccgaaaggcgagugaggucuaggacagu

SEQ ID NO: 20216 - RNA, 37 nt, Artificial Sequence
  Description of Artificial Sequence:  Enzymatic Nucleic Acid
ccccgcaggccgaaaggcgagugaggucugcaggaca

SEQ ID NO: 20217 - RNA, 37 nt, Artificial Sequence
  Description of Artificial Sequence:  Enzymatic Nucleic Acid
gcaccccggccgaaaggcgagugaggucuagcgcagg

SEQ ID NO: 20218 - RNA, 37 nt, Artificial Sequence
  Description of Artificial Sequence:  Enzymatic Nucleic Acid
ucgcggcagccgaaaggcgagugaggucucccgcagc

SEQ ID NO: 20219 - RNA, 37 nt, Artificial Sequence
  Description of Artificial Sequence:  Enzymatic Nucleic Acid
acucgcgggccgaaaggcgagugaggucuaccccgca

SEQ ID NO: 20220 - RNA, 37 nt, Artificial Sequence
  Description of Artificial Sequence:  Enzymatic Nucleic Acid
ggaacucggccgaaaggcgagugaggucuggcacccc

SEQ ID NO: 20221 - RNA, 37 nt, Artificial Sequence
  Description of Artificial Sequence:  Enzymatic Nucleic Acid
agguggaagccgaaaggcgagugaggucuucgcggca

SEQ ID NO: 20222 - RNA, 37 nt, Artificial Sequence
  Description of Artificial Sequence:  Enzymatic Nucleic Acid
aggaggcggccgaaaggcgagugaggucuggaggugg

SEQ ID NO: 20223 - RNA, 37 nt, Artificial Sequence
  Description of Artificial Sequence:  Enzymatic Nucleic Acid
gaaggagggccgaaaggcgagugaggucugcggaggu

SEQ ID NO: 20224 - RNA, 37 nt, Artificial Sequence
  Description of Artificial Sequence:  Enzymatic Nucleic Acid
ucccagcggccgaaaggcgagugaggucucugucuag

SEQ ID NO: 20225 - RNA, 37 nt, Artificial Sequence
  Description of Artificial Sequence:  Enzymatic Nucleic Acid
ucucccaggccgaaaggcgagugaggucugccugucu

SEQ ID NO: 20226 - RNA, 37 nt, Artificial Sequence
  Description of Artificial Sequence:  Enzymatic Nucleic Acid
cucgggaggccgaaaggcgagugaggucucgguucuu

SEQ ID NO: 20227 - RNA, 37 nt, Artificial Sequence
  Description of Artificial Sequence:  Enzymatic Nucleic Acid
gcccagaagccgaaaggcgagugaggucuucgggagc

SEQ ID NO: 20228 - RNA, 37 nt, Artificial Sequence
  Description of Artificial Sequence:  Enzymatic Nucleic Acid
gcgaaauggccgaaaggcgagugaggucuccagaacu

SEQ ID NO: 20229 - RNA, 37 nt, Artificial Sequence
  Description of Artificial Sequence:  Enzymatic Nucleic Acid
gagccggggccgaaaggcgagugaggucugaaaugcc

SEQ ID NO: 20230 - RNA, 37 nt, Artificial Sequence
  Description of Artificial Sequence:  Enzymatic Nucleic Acid
accucgaggccgaaaggcgagugaggucucgggcgaa

SEQ ID NO: 20231 - RNA, 37 nt, Artificial Sequence
  Description of Artificial Sequence:  Enzymatic Nucleic Acid
auccugcagccgaaaggcgagugaggucucucgagcc

SEQ ID NO: 20232 - RNA, 37 nt, Artificial Sequence
  Description of Artificial Sequence:  Enzymatic Nucleic Acid
gcauccuggccgaaaggcgagugaggucuaccucgag

SEQ ID NO: 20233 - RNA, 37 nt, Artificial Sequence
  Description of Artificial Sequence:  Enzymatic Nucleic Acid
uugcucuggccgaaaggcgagugaggucuauccugca

SEQ ID NO: 20234 - RNA, 37 nt, Artificial Sequence
  Description of Artificial Sequence:  Enzymatic Nucleic Acid
gcaccuuggccgaaaggcgagugaggucuucugcauc

SEQ ID NO: 20235 - RNA, 37 nt, Artificial Sequence
  Description of Artificial Sequence:  Enzymatic Nucleic Acid
cagcagcagccgaaaggcgagugaggucucuugcucu

SEQ ID NO: 20236 - RNA, 37 nt, Artificial Sequence
  Description of Artificial Sequence:  Enzymatic Nucleic Acid
gccagcaggccgaaaggcgagugaggucuaccuugcu

SEQ ID NO: 20237 - RNA, 37 nt, Artificial Sequence
  Description of Artificial Sequence:  Enzymatic Nucleic Acid
acggccaggccgaaaggcgagugaggucuagcaccuu

SEQ ID NO: 20238 - RNA, 37 nt, Artificial Sequence
  Description of Artificial Sequence:  Enzymatic Nucleic Acid
ggcgacgggccgaaaggcgagugaggucucagcagca

SEQ ID NO: 20239 - RNA, 37 nt, Artificial Sequence
  Description of Artificial Sequence:  Enzymatic Nucleic Acid
cagggcgagccgaaaggcgagugaggucuggccagca

SEQ ID NO: 20240 - RNA, 37 nt, Artificial Sequence
  Description of Artificial Sequence:  Enzymatic Nucleic Acid
ccacaggggccgaaaggcgagugaggucugacggcca

SEQ ID NO: 20241 - RNA, 37 nt, Artificial Sequence
  Description of Artificial Sequence:  Enzymatic Nucleic Acid
cagagccagccgaaaggcgagugaggucuagggcgac

SEQ ID NO: 20242 - RNA, 37 nt, Artificial Sequence
  Description of Artificial Sequence:  Enzymatic Nucleic Acid
acgcagaggccgaaaggcgagugaggucucacagggc

SEQ ID NO: 20243 - RNA, 37 nt, Artificial Sequence
  Description of Artificial Sequence:  Enzymatic Nucleic Acid
ucuccacggccgaaaggcgagugaggucuagagccac

SEQ ID NO: 20244 - RNA, 37 nt, Artificial Sequence
  Description of Artificial Sequence:  Enzymatic Nucleic Acid
ggucuccagccgaaaggcgagugaggucugcagagcc

SEQ ID NO: 20245 - RNA, 37 nt, Artificial Sequence
  Description of Artificial Sequence:  Enzymatic Nucleic Acid
agaggcgggccgaaaggcgagugaggucuccgggucu

SEQ ID NO: 20246 - RNA, 37 nt, Artificial Sequence
  Description of Artificial Sequence:  Enzymatic Nucleic Acid
cacagagggccgaaaggcgagugaggucuggcccggg

SEQ ID NO: 20247 - RNA, 37 nt, Artificial Sequence
  Description of Artificial Sequence:  Enzymatic Nucleic Acid
caaacccagccgaaaggcgagugaggucuagaggcgg

SEQ ID NO: 20248 - RNA, 37 nt, Artificial Sequence
  Description of Artificial Sequence:  Enzymatic Nucleic Acid
uaggcaaagccgaaaggcgagugaggucuccacagag

SEQ ID NO: 20249 - RNA, 37 nt, Artificial Sequence
  Description of Artificial Sequence:  Enzymatic Nucleic Acid
acacuagggccgaaaggcgagugaggucuaaacccac

SEQ ID NO: 20250 - RNA, 37 nt, Artificial Sequence
  Description of Artificial Sequence:  Enzymatic Nucleic Acid
gagaaacagccgaaaggcgagugaggucuuaggcaaa

SEQ ID NO: 20251 - RNA, 37 nt, Artificial Sequence
  Description of Artificial Sequence:  Enzymatic Nucleic Acid
aagagaaagccgaaaggcgagugaggucuacuaggca

SEQ ID NO: 20252 - RNA, 37 nt, Artificial Sequence
  Description of Artificial Sequence:  Enzymatic Nucleic Acid
agccuggggccgaaaggcgagugaggucuagaucaag

SEQ ID NO: 20253 - RNA, 37 nt, Artificial Sequence
  Description of Artificial Sequence:  Enzymatic Nucleic Acid
augcugaggccgaaaggcgagugaggucucugggcag

SEQ ID NO: 20254 - RNA, 37 nt, Artificial Sequence
  Description of Artificial Sequence:  Enzymatic Nucleic Acid
uuuguauggccgaaaggcgagugaggucuugagccug

SEQ ID NO: 20255 - RNA, 37 nt, Artificial Sequence
  Description of Artificial Sequence:  Enzymatic Nucleic Acid
uguauuaggccgaaaggcgagugaggucucuuaauug

SEQ ID NO: 20256 - RNA, 37 nt, Artificial Sequence
  Description of Artificial Sequence:  Enzymatic Nucleic Acid
guccccuggccgaaaggcgagugaggucuaaguaauu

SEQ ID NO: 20257 - RNA, 37 nt, Artificial Sequence
  Description of Artificial Sequence:  Enzymatic Nucleic Acid
ggccaaaggccgaaaggcgagugaggucucaguccaa

SEQ ID NO: 20258 - RNA, 37 nt, Artificial Sequence
  Description of Artificial Sequence:  Enzymatic Nucleic Acid
uuauuggggccgaaaggcgagugaggucucaaagcca

SEQ ID NO: 20259 - RNA, 37 nt, Artificial Sequence
  Description of Artificial Sequence:  Enzymatic Nucleic Acid
cacugccagccgaaaggcgagugaggucuucugauua

SEQ ID NO: 20260 - RNA, 37 nt, Artificial Sequence
  Description of Artificial Sequence:  Enzymatic Nucleic Acid
gcucacuggccgaaaggcgagugaggucucacucuga

SEQ ID NO: 20261 - RNA, 37 nt, Artificial Sequence
  Description of Artificial Sequence:  Enzymatic Nucleic Acid
uuugcucagccgaaaggcgagugaggucuugccacuc

SEQ ID NO: 20262 - RNA, 37 nt, Artificial Sequence
  Description of Artificial Sequence:  Enzymatic Nucleic Acid
acccuuuggccgaaaggcgagugaggucuucacugcc

SEQ ID NO: 20263 - RNA, 37 nt, Artificial Sequence
  Description of Artificial Sequence:  Enzymatic Nucleic Acid
caccuccagccgaaaggcgagugaggucuccuuugcu

SEQ ID NO: 20264 - RNA, 37 nt, Artificial Sequence
  Description of Artificial Sequence:  Enzymatic Nucleic Acid
cucagucagccgaaaggcgagugaggucucuccaccc

SEQ ID NO: 20265 - RNA, 37 nt, Artificial Sequence
  Description of Artificial Sequence:  Enzymatic Nucleic Acid
ucgcugcagccgaaaggcgagugaggucuucagucac

SEQ ID NO: 20266 - RNA, 37 nt, Artificial Sequence
  Description of Artificial Sequence:  Enzymatic Nucleic Acid
caucgcuggccgaaaggcgagugaggucuacucaguc

SEQ ID NO: 20267 - RNA, 37 nt, Artificial Sequence
  Description of Artificial Sequence:  Enzymatic Nucleic Acid
ggccaucggccgaaaggcgagugaggucuugcacuca

SEQ ID NO: 20268 - RNA, 37 nt, Artificial Sequence
  Description of Artificial Sequence:  Enzymatic Nucleic Acid
agaagagggccgaaaggcgagugaggucucaucgcug

SEQ ID NO: 20269 - RNA, 37 nt, Artificial Sequence
  Description of Artificial Sequence:  Enzymatic Nucleic Acid
gugucuuagccgaaaggcgagugaggucuagaagagg

SEQ ID NO: 20270 - RNA, 37 nt, Artificial Sequence
  Description of Artificial Sequence:  Enzymatic Nucleic Acid
uccgaucagccgaaaggcgagugaggucuuuuuggaa

SEQ ID NO: 20271 - RNA, 37 nt, Artificial Sequence
  Description of Artificial Sequence:  Enzymatic Nucleic Acid
cuuguagggccgaaaggcgagugaggucuuccagugu

SEQ ID NO: 20272 - RNA, 37 nt, Artificial Sequence
  Description of Artificial Sequence:  Enzymatic Nucleic Acid
uagaagcagccgaaaggcgagugaggucuuuguaggc

SEQ ID NO: 20273 - RNA, 37 nt, Artificial Sequence
  Description of Artificial Sequence:  Enzymatic Nucleic Acid
gguagaaggccgaaaggcgagugaggucuacuuguag

SEQ ID NO: 20274 - RNA, 37 nt, Artificial Sequence
  Description of Artificial Sequence:  Enzymatic Nucleic Acid
gaccgagggccgaaaggcgagugaggucucaagucag

SEQ ID NO: 20275 - RNA, 37 nt, Artificial Sequence
  Description of Artificial Sequence:  Enzymatic Nucleic Acid
auaaaugagccgaaaggcgagugaggucucgaggcca

SEQ ID NO: 20276 - RNA, 37 nt, Artificial Sequence
  Description of Artificial Sequence:  Enzymatic Nucleic Acid
aacauagagccgaaaggcgagugaggucuauaaauga

SEQ ID NO: 20277 - RNA, 37 nt, Artificial Sequence
  Description of Artificial Sequence:  Enzymatic Nucleic Acid
aucuugaagccgaaaggcgagugaggucuauagacau

SEQ ID NO: 20278 - RNA, 37 nt, Artificial Sequence
  Description of Artificial Sequence:  Enzymatic Nucleic Acid
aacagaaggccgaaaggcgagugaggucuaauaaaug

SEQ ID NO: 20279 - RNA, 37 nt, Artificial Sequence
  Description of Artificial Sequence:  Enzymatic Nucleic Acid
gucacuaagccgaaaggcgagugaggucuagaagcaa

SEQ ID NO: 20280 - RNA, 37 nt, Artificial Sequence
  Description of Artificial Sequence:  Enzymatic Nucleic Acid
guuggucagccgaaaggcgagugaggucuuaacagaa

SEQ ID NO: 20281 - RNA, 37 nt, Artificial Sequence
  Description of Artificial Sequence:  Enzymatic Nucleic Acid
guacacgagccgaaaggcgagugaggucuuccauguu

SEQ ID NO: 20282 - RNA, 37 nt, Artificial Sequence
  Description of Artificial Sequence:  Enzymatic Nucleic Acid
aauguacagccgaaaggcgagugaggucugacuccau

SEQ ID NO: 20283 - RNA, 37 nt, Artificial Sequence
  Description of Artificial Sequence:  Enzymatic Nucleic Acid
guaauguagccgaaaggcgagugaggucuacgacucc

SEQ ID NO: 20284 - RNA, 37 nt, Artificial Sequence
  Description of Artificial Sequence:  Enzymatic Nucleic Acid
aaucaccagccgaaaggcgagugaggucuaguuuugu

SEQ ID NO: 20285 - RNA, 37 nt, Artificial Sequence
  Description of Artificial Sequence:  Enzymatic Nucleic Acid
uggaaucagccgaaaggcgagugaggucucacaguuu

SEQ ID NO: 20286 - RNA, 37 nt, Artificial Sequence
  Description of Artificial Sequence:  Enzymatic Nucleic Acid
acccgagagccgaaaggcgagugaggucuauggaauc

SEQ ID NO: 20287 - RNA, 37 nt, Artificial Sequence
  Description of Artificial Sequence:  Enzymatic Nucleic Acid
gaaauggagccgaaaggcgagugaggucuccgagaca

SEQ ID NO: 20288 - RNA, 37 nt, Artificial Sequence
  Description of Artificial Sequence:  Enzymatic Nucleic Acid
aagugacagccgaaaggcgagugaggucuguugagau

SEQ ID NO: 20289 - RNA, 37 nt, Artificial Sequence
  Description of Artificial Sequence:  Enzymatic Nucleic Acid
caaagugagccgaaaggcgagugaggucuacguugag

SEQ ID NO: 20290 - RNA, 37 nt, Artificial Sequence
  Description of Artificial Sequence:  Enzymatic Nucleic Acid
aucuugcagccgaaaggcgagugaggucuaaagugac

SEQ ID NO: 20291 - RNA, 37 nt, Artificial Sequence
  Description of Artificial Sequence:  Enzymatic Nucleic Acid
guaucuuggccgaaaggcgagugaggucuacaaagug

SEQ ID NO: 20292 - RNA, 37 nt, Artificial Sequence
  Description of Artificial Sequence:  Enzymatic Nucleic Acid
aucaggaagccgaaaggcgagugaggucuaaaucucu

SEQ ID NO: 20293 - RNA, 37 nt, Artificial Sequence
  Description of Artificial Sequence:  Enzymatic Nucleic Acid
uucuguuagccgaaaggcgagugaggucucaucagga

SEQ ID NO: 20294 - RNA, 37 nt, Artificial Sequence
  Description of Artificial Sequence:  Enzymatic Nucleic Acid
ccuucuuggccgaaaggcgagugaggucuugucccag

SEQ ID NO: 20295 - RNA, 37 nt, Artificial Sequence
  Description of Artificial Sequence:  Enzymatic Nucleic Acid
uaguaaaggccgaaaggcgagugaggucuccuucuug

SEQ ID NO: 20296 - RNA, 37 nt, Artificial Sequence
  Description of Artificial Sequence:  Enzymatic Nucleic Acid
ucauguaggccgaaaggcgagugaggucuugggaaua

SEQ ID NO: 20297 - RNA, 37 nt, Artificial Sequence
  Description of Artificial Sequence:  Enzymatic Nucleic Acid
cagcauaggccgaaaggcgagugaggucuugaucaug

SEQ ID NO: 20298 - RNA, 37 nt, Artificial Sequence
  Description of Artificial Sequence:  Enzymatic Nucleic Acid
caugccaggccgaaaggcgagugaggucuauagcuga

SEQ ID NO: 20299 - RNA, 37 nt, Artificial Sequence
  Description of Artificial Sequence:  Enzymatic Nucleic Acid
agaccauggccgaaaggcgagugaggucucagcauag

SEQ ID NO: 20300 - RNA, 37 nt, Artificial Sequence
  Description of Artificial Sequence:  Enzymatic Nucleic Acid
acagaagagccgaaaggcgagugaggucucaugccag

SEQ ID NO: 20301 - RNA, 37 nt, Artificial Sequence
  Description of Artificial Sequence:  Enzymatic Nucleic Acid
uugcuucagccgaaaggcgagugaggucuagaagacc

SEQ ID NO: 20302 - RNA, 37 nt, Artificial Sequence
  Description of Artificial Sequence:  Enzymatic Nucleic Acid
aauuuuuggccgaaaggcgagugaggucuuucacaga

SEQ ID NO: 20303 - RNA, 37 nt, Artificial Sequence
  Description of Artificial Sequence:  Enzymatic Nucleic Acid
acugguaagccgaaaggcgagugaggucuuuucauca

SEQ ID NO: 20304 - RNA, 37 nt, Artificial Sequence
  Description of Artificial Sequence:  Enzymatic Nucleic Acid
auaauagagccgaaaggcgagugaggucuugguaacu

SEQ ID NO: 20305 - RNA, 37 nt, Artificial Sequence
  Description of Artificial Sequence:  Enzymatic Nucleic Acid
acuauguagccgaaaggcgagugaggucuauaauaga

SEQ ID NO: 20306 - RNA, 37 nt, Artificial Sequence
  Description of Artificial Sequence:  Enzymatic Nucleic Acid
aacgacaagccgaaaggcgagugaggucuuauguaca

SEQ ID NO: 20307 - RNA, 37 nt, Artificial Sequence
  Description of Artificial Sequence:  Enzymatic Nucleic Acid
uacaacgagccgaaaggcgagugaggucuaacuaugu

SEQ ID NO: 20308 - RNA, 37 nt, Artificial Sequence
  Description of Artificial Sequence:  Enzymatic Nucleic Acid
cccuacaagccgaaaggcgagugaggucugacaacua

SEQ ID NO: 20309 - RNA, 37 nt, Artificial Sequence
  Description of Artificial Sequence:  Enzymatic Nucleic Acid
auacccuagccgaaaggcgagugaggucuaacgacaa

SEQ ID NO: 20310 - RNA, 37 nt, Artificial Sequence
  Description of Artificial Sequence:  Enzymatic Nucleic Acid
auccuauagccgaaaggcgagugaggucuccuacaac

SEQ ID NO: 20311 - RNA, 37 nt, Artificial Sequence
  Description of Artificial Sequence:  Enzymatic Nucleic Acid
cagaaccagccgaaaggcgagugaggucuaucauaaa

SEQ ID NO: 20312 - RNA, 37 nt, Artificial Sequence
  Description of Artificial Sequence:  Enzymatic Nucleic Acid
acucagaagccgaaaggcgagugaggucucacaucau

SEQ ID NO: 20313 - RNA, 37 nt, Artificial Sequence
  Description of Artificial Sequence:  Enzymatic Nucleic Acid
gagacggagccgaaaggcgagugaggucuucagaacc

SEQ ID NO: 20314 - RNA, 37 nt, Artificial Sequence
  Description of Artificial Sequence:  Enzymatic Nucleic Acid
ccaugagagccgaaaggcgagugaggucuggacucag

SEQ ID NO: 20315 - RNA, 37 nt, Artificial Sequence
  Description of Artificial Sequence:  Enzymatic Nucleic Acid
uucuccaagccgaaaggcgagugaggucuagauaguu

SEQ ID NO: 20316 - RNA, 37 nt, Artificial Sequence
  Description of Artificial Sequence:  Enzymatic Nucleic Acid
aagacaaggccgaaaggcgagugaggucuuuuucucc

SEQ ID NO: 20317 - RNA, 37 nt, Artificial Sequence
  Description of Artificial Sequence:  Enzymatic Nucleic Acid
auuuaagagccgaaaggcgagugaggucuaagcuuuu

SEQ ID NO: 20318 - RNA, 37 nt, Artificial Sequence
  Description of Artificial Sequence:  Enzymatic Nucleic Acid
uugcuguagccgaaaggcgagugaggucuaauuuaag

SEQ ID NO: 20319 - RNA, 37 nt, Artificial Sequence
  Description of Artificial Sequence:  Enzymatic Nucleic Acid
aguucuuggccgaaaggcgagugaggucuuguacaau

SEQ ID NO: 20320 - RNA, 37 nt, Artificial Sequence
  Description of Artificial Sequence:  Enzymatic Nucleic Acid
aauccccagccgaaaggcgagugaggucuauuuaguu

SEQ ID NO: 20321 - RNA, 37 nt, Artificial Sequence
  Description of Artificial Sequence:  Enzymatic Nucleic Acid
ugcugauggccgaaaggcgagugaggucuuucgaaga

SEQ ID NO: 20322 - RNA, 37 nt, Artificial Sequence
  Description of Artificial Sequence:  Enzymatic Nucleic Acid
uucuuauggccgaaaggcgagugaggucuugaugcuu

SEQ ID NO: 20323 - RNA, 37 nt, Artificial Sequence
  Description of Artificial Sequence:  Enzymatic Nucleic Acid
ucgguuuagccgaaaggcgagugaggucuaaguuucu

SEQ ID NO: 20324 - RNA, 37 nt, Artificial Sequence
  Description of Artificial Sequence:  Enzymatic Nucleic Acid
cucccagagccgaaaggcgagugaggucuuggguuuu

SEQ ID NO: 20325 - RNA, 37 nt, Artificial Sequence
  Description of Artificial Sequence:  Enzymatic Nucleic Acid
ucaucucagccgaaaggcgagugaggucuucccagac

SEQ ID NO: 20326 - RNA, 37 nt, Artificial Sequence
  Description of Artificial Sequence:  Enzymatic Nucleic Acid
uuaagguggccgaaaggcgagugaggucuucaaaaau

SEQ ID NO: 20327 - RNA, 37 nt, Artificial Sequence
  Description of Artificial Sequence:  Enzymatic Nucleic Acid
ggguuacagccgaaaggcgagugaggucucaucuaua

SEQ ID NO: 20328 - RNA, 37 nt, Artificial Sequence
  Description of Artificial Sequence:  Enzymatic Nucleic Acid
ccggguuagccgaaaggcgagugaggucuaccaucua

SEQ ID NO: 20329 - RNA, 37 nt, Artificial Sequence
  Description of Artificial Sequence:  Enzymatic Nucleic Acid
cuuggucagccgaaaggcgagugaggucuuccggguu

SEQ ID NO: 20330 - RNA, 37 nt, Artificial Sequence
  Description of Artificial Sequence:  Enzymatic Nucleic Acid
cagguguagccgaaaggcgagugaggucuaauccuug

SEQ ID NO: 20331 - RNA, 37 nt, Artificial Sequence
  Description of Artificial Sequence:  Enzymatic Nucleic Acid
augcugcagccgaaaggcgagugaggucuagguguac

SEQ ID NO: 20332 - RNA, 37 nt, Artificial Sequence
  Description of Artificial Sequence:  Enzymatic Nucleic Acid
ggaugcuggccgaaaggcgagugaggucuacaggugu

SEQ ID NO: 20333 - RNA, 37 nt, Artificial Sequence
  Description of Artificial Sequence:  Enzymatic Nucleic Acid
acuggauggccgaaaggcgagugaggucuugcacagg

SEQ ID NO: 20334 - RNA, 37 nt, Artificial Sequence
  Description of Artificial Sequence:  Enzymatic Nucleic Acid
ucagcccagccgaaaggcgagugaggucuuggaugcu

SEQ ID NO: 20335 - RNA, 37 nt, Artificial Sequence
  Description of Artificial Sequence:  Enzymatic Nucleic Acid
gucaucaggccgaaaggcgagugaggucuccacugga

SEQ ID NO: 20336 - RNA, 37 nt, Artificial Sequence
  Description of Artificial Sequence:  Enzymatic Nucleic Acid
caaauguggccgaaaggcgagugaggucuuguucuuc

SEQ ID NO: 20337 - RNA, 37 nt, Artificial Sequence
  Description of Artificial Sequence:  Enzymatic Nucleic Acid
gacccugagccgaaaggcgagugaggucuaaaugugc

SEQ ID NO: 20338 - RNA, 37 nt, Artificial Sequence
  Description of Artificial Sequence:  Enzymatic Nucleic Acid
uucauggagccgaaaggcgagugaggucuccugacaa

SEQ ID NO: 20339 - RNA, 37 nt, Artificial Sequence
  Description of Artificial Sequence:  Enzymatic Nucleic Acid
aaaagcaagccgaaaggcgagugaggucuaaaagguu

SEQ ID NO: 20340 - RNA, 37 nt, Artificial Sequence
  Description of Artificial Sequence:  Enzymatic Nucleic Acid
uccaaaaggccgaaaggcgagugaggucuaacaaaag

SEQ ID NO: 20341 - RNA, 37 nt, Artificial Sequence
  Description of Artificial Sequence:  Enzymatic Nucleic Acid
ccaugccagccgaaaggcgagugaggucuuuccaaaa

SEQ ID NO: 20342 - RNA, 37 nt, Artificial Sequence
  Description of Artificial Sequence:  Enzymatic Nucleic Acid
auuccauggccgaaaggcgagugaggucucacuucca

SEQ ID NO: 20343 - RNA, 37 nt, Artificial Sequence
  Description of Artificial Sequence:  Enzymatic Nucleic Acid
ggcuuccagccgaaaggcgagugaggucucagagauu

SEQ ID NO: 20344 - RNA, 37 nt, Artificial Sequence
  Description of Artificial Sequence:  Enzymatic Nucleic Acid
caccgugggccgaaaggcgagugaggucuuuccacca

SEQ ID NO: 20345 - RNA, 37 nt, Artificial Sequence
  Description of Artificial Sequence:  Enzymatic Nucleic Acid
cucccccagccgaaaggcgagugaggucucguggcuu

SEQ ID NO: 20346 - RNA, 37 nt, Artificial Sequence
  Description of Artificial Sequence:  Enzymatic Nucleic Acid
cugacacggccgaaaggcgagugaggucuucccccac

SEQ ID NO: 20347 - RNA, 37 nt, Artificial Sequence
  Description of Artificial Sequence:  Enzymatic Nucleic Acid
uucugacagccgaaaggcgagugaggucugcuccccc

SEQ ID NO: 20348 - RNA, 37 nt, Artificial Sequence
  Description of Artificial Sequence:  Enzymatic Nucleic Acid
gauucugagccgaaaggcgagugaggucuacgcuccc

SEQ ID NO: 20349 - RNA, 37 nt, Artificial Sequence
  Description of Artificial Sequence:  Enzymatic Nucleic Acid
guacuucggccgaaaggcgagugaggucuagggauuc

SEQ ID NO: 20350 - RNA, 37 nt, Artificial Sequence
  Description of Artificial Sequence:  Enzymatic Nucleic Acid
ccaagguagccgaaaggcgagugaggucuuucgcagg

SEQ ID NO: 20351 - RNA, 37 nt, Artificial Sequence
  Description of Artificial Sequence:  Enzymatic Nucleic Acid
guggguaagccgaaaggcgagugaggucucaagguac

SEQ ID NO: 20352 - RNA, 37 nt, Artificial Sequence
  Description of Artificial Sequence:  Enzymatic Nucleic Acid
uuuuuauagccgaaaggcgagugaggucucauuuuau

SEQ ID NO: 20353 - RNA, 37 nt, Artificial Sequence
  Description of Artificial Sequence:  Enzymatic Nucleic Acid
ugauuggagccgaaaggcgagugaggucuucaagggg

SEQ ID NO: 20354 - RNA, 37 nt, Artificial Sequence
  Description of Artificial Sequence:  Enzymatic Nucleic Acid
augccccggccgaaaggcgagugaggucuuuuaauug

SEQ ID NO: 20355 - RNA, 37 nt, Artificial Sequence
  Description of Artificial Sequence:  Enzymatic Nucleic Acid
aguacauggccgaaaggcgagugaggucucccgcuuu

SEQ ID NO: 20356 - RNA, 37 nt, Artificial Sequence
  Description of Artificial Sequence:  Enzymatic Nucleic Acid
cgucaguagccgaaaggcgagugaggucuaugccccg

SEQ ID NO: 20357 - RNA, 37 nt, Artificial Sequence
  Description of Artificial Sequence:  Enzymatic Nucleic Acid
uucacucagccgaaaggcgagugaggucuuuccauaa

SEQ ID NO: 20358 - RNA, 37 nt, Artificial Sequence
  Description of Artificial Sequence:  Enzymatic Nucleic Acid
cucuuucagccgaaaggcgagugaggucuucacuucc

SEQ ID NO: 20359 - RNA, 37 nt, Artificial Sequence
  Description of Artificial Sequence:  Enzymatic Nucleic Acid
aaggaugagccgaaaggcgagugaggucuaguguaau

SEQ ID NO: 20360 - RNA, 37 nt, Artificial Sequence
  Description of Artificial Sequence:  Enzymatic Nucleic Acid
uggcucuggccgaaaggcgagugaggucuuucuccuu

SEQ ID NO: 20361 - RNA, 37 nt, Artificial Sequence
  Description of Artificial Sequence:  Enzymatic Nucleic Acid
ccacaugggccgaaaggcgagugaggucuucugcuuc

SEQ ID NO: 20362 - RNA, 37 nt, Artificial Sequence
  Description of Artificial Sequence:  Enzymatic Nucleic Acid
agagaccagccgaaaggcgagugaggucuauggcucu

SEQ ID NO: 20363 - RNA, 37 nt, Artificial Sequence
  Description of Artificial Sequence:  Enzymatic Nucleic Acid
cagagagagccgaaaggcgagugaggucucacauggc

SEQ ID NO: 20364 - RNA, 37 nt, Artificial Sequence
  Description of Artificial Sequence:  Enzymatic Nucleic Acid
auacacaagccgaaaggcgagugaggucucagagaga

SEQ ID NO: 20365 - RNA, 37 nt, Artificial Sequence
  Description of Artificial Sequence:  Enzymatic Nucleic Acid
gacauacagccgaaaggcgagugaggucuaaccagag

SEQ ID NO: 20366 - RNA, 37 nt, Artificial Sequence
  Description of Artificial Sequence:  Enzymatic Nucleic Acid
gggacauagccgaaaggcgagugaggucuacaaccag

SEQ ID NO: 20367 - RNA, 37 nt, Artificial Sequence
  Description of Artificial Sequence:  Enzymatic Nucleic Acid
gggugggagccgaaaggcgagugaggucuauacacaa

SEQ ID NO: 20368 - RNA, 37 nt, Artificial Sequence
  Description of Artificial Sequence:  Enzymatic Nucleic Acid
auuucucagccgaaaggcgagugaggucucaaucugg

SEQ ID NO: 20369 - RNA, 37 nt, Artificial Sequence
  Description of Artificial Sequence:  Enzymatic Nucleic Acid
ggaauccagccgaaaggcgagugaggucuaggagaga

SEQ ID NO: 20370 - RNA, 37 nt, Artificial Sequence
  Description of Artificial Sequence:  Enzymatic Nucleic Acid
gugccguagccgaaaggcgagugaggucuugguagga

SEQ ID NO: 20371 - RNA, 37 nt, Artificial Sequence
  Description of Artificial Sequence:  Enzymatic Nucleic Acid
gagugguggccgaaaggcgagugaggucucguacugg

SEQ ID NO: 20372 - RNA, 37 nt, Artificial Sequence
  Description of Artificial Sequence:  Enzymatic Nucleic Acid
caugucaggccgaaaggcgagugaggucuguuugagu

SEQ ID NO: 20373 - RNA, 37 nt, Artificial Sequence
  Description of Artificial Sequence:  Enzymatic Nucleic Acid
agaccguagccgaaaggcgagugaggucuaugucagc

SEQ ID NO: 20374 - RNA, 37 nt, Artificial Sequence
  Description of Artificial Sequence:  Enzymatic Nucleic Acid
ggcauagagccgaaaggcgagugaggucucguacaug

SEQ ID NO: 20375 - RNA, 37 nt, Artificial Sequence
  Description of Artificial Sequence:  Enzymatic Nucleic Acid
aggaaugggccgaaaggcgagugaggucuauagaccg

SEQ ID NO: 20376 - RNA, 37 nt, Artificial Sequence
  Description of Artificial Sequence:  Enzymatic Nucleic Acid
augugauggccgaaaggcgagugaggucugggggagg

SEQ ID NO: 20377 - RNA, 37 nt, Artificial Sequence
  Description of Artificial Sequence:  Enzymatic Nucleic Acid
ugccaauagccgaaaggcgagugaggucucaguggau

SEQ ID NO: 20378 - RNA, 37 nt, Artificial Sequence
  Description of Artificial Sequence:  Enzymatic Nucleic Acid
uccaacuggccgaaaggcgagugaggucucaauacca

SEQ ID NO: 20379 - RNA, 37 nt, Artificial Sequence
  Description of Artificial Sequence:  Enzymatic Nucleic Acid
uccuccaagccgaaaggcgagugaggucuugccaaua

SEQ ID NO: 20380 - RNA, 37 nt, Artificial Sequence
  Description of Artificial Sequence:  Enzymatic Nucleic Acid
uuggcgcagccgaaaggcgagugaggucuucuuccuc

SEQ ID NO: 20381 - RNA, 37 nt, Artificial Sequence
  Description of Artificial Sequence:  Enzymatic Nucleic Acid
cguuggcggccgaaaggcgagugaggucuacucuucc

SEQ ID NO: 20382 - RNA, 37 nt, Artificial Sequence
  Description of Artificial Sequence:  Enzymatic Nucleic Acid
cucguugggccgaaaggcgagugaggucugcacucuu

SEQ ID NO: 20383 - RNA, 37 nt, Artificial Sequence
  Description of Artificial Sequence:  Enzymatic Nucleic Acid
uggcuggggccgaaaggcgagugaggucuucguuggc

SEQ ID NO: 20384 - RNA, 37 nt, Artificial Sequence
  Description of Artificial Sequence:  Enzymatic Nucleic Acid
cagcuugggccgaaaggcgagugaggucuugggcucg

SEQ ID NO: 20385 - RNA, 37 nt, Artificial Sequence
  Description of Artificial Sequence:  Enzymatic Nucleic Acid
ugagacaggccgaaaggcgagugaggucuuuggcugg

SEQ ID NO: 20386 - RNA, 37 nt, Artificial Sequence
  Description of Artificial Sequence:  Enzymatic Nucleic Acid
cacugagagccgaaaggcgagugaggucuagcuuggc

SEQ ID NO: 20387 - RNA, 37 nt, Artificial Sequence
  Description of Artificial Sequence:  Enzymatic Nucleic Acid
guuugucagccgaaaggcgagugaggucuugagacag

SEQ ID NO: 20388 - RNA, 37 nt, Artificial Sequence
  Description of Artificial Sequence:  Enzymatic Nucleic Acid
auucuucagccgaaaggcgagugaggucuaaggguau

SEQ ID NO: 20389 - RNA, 37 nt, Artificial Sequence
  Description of Artificial Sequence:  Enzymatic Nucleic Acid
ccuccacagccgaaaggcgagugaggucuuucuccau

SEQ ID NO: 20390 - RNA, 37 nt, Artificial Sequence
  Description of Artificial Sequence:  Enzymatic Nucleic Acid
guccuccagccgaaaggcgagugaggucuacuucucc

SEQ ID NO: 20391 - RNA, 37 nt, Artificial Sequence
  Description of Artificial Sequence:  Enzymatic Nucleic Acid
uuuauuaagccgaaaggcgagugaggucuuucaauuu

SEQ ID NO: 20392 - RNA, 37 nt, Artificial Sequence
  Description of Artificial Sequence:  Enzymatic Nucleic Acid
aauuagaggccgaaaggcgagugaggucuaaauugau

SEQ ID NO: 20393 - RNA, 37 nt, Artificial Sequence
  Description of Artificial Sequence:  Enzymatic Nucleic Acid
gguacuuagccgaaaggcgagugaggucuaguuuugu

SEQ ID NO: 20394 - RNA, 37 nt, Artificial Sequence
  Description of Artificial Sequence:  Enzymatic Nucleic Acid
caaggguagccgaaaggcgagugaggucuuuacaguu

SEQ ID NO: 20395 - RNA, 37 nt, Artificial Sequence
  Description of Artificial Sequence:  Enzymatic Nucleic Acid
uuggauaagccgaaaggcgagugaggucuaaggguac

SEQ ID NO: 20396 - RNA, 37 nt, Artificial Sequence
  Description of Artificial Sequence:  Enzymatic Nucleic Acid
auuugccggccgaaaggcgagugaggucuuuggauaa

SEQ ID NO: 20397 - RNA, 37 nt, Artificial Sequence
  Description of Artificial Sequence:  Enzymatic Nucleic Acid
cacauuuggccgaaaggcgagugaggucucgcuugga

SEQ ID NO: 20398 - RNA, 37 nt, Artificial Sequence
  Description of Artificial Sequence:  Enzymatic Nucleic Acid
agcugacagccgaaaggcgagugaggucuauuugccg

SEQ ID NO: 20399 - RNA, 37 nt, Artificial Sequence
  Description of Artificial Sequence:  Enzymatic Nucleic Acid
aaagcugagccgaaaggcgagugaggucuacauuugc

SEQ ID NO: 20400 - RNA, 37 nt, Artificial Sequence
  Description of Artificial Sequence:  Enzymatic Nucleic Acid
guacaaaggccgaaaggcgagugaggucuugacacau

SEQ ID NO: 20401 - RNA, 37 nt, Artificial Sequence
  Description of Artificial Sequence:  Enzymatic Nucleic Acid
cauuuguagccgaaaggcgagugaggucuaaagcuga

SEQ ID NO: 20402 - RNA, 37 nt, Artificial Sequence
  Description of Artificial Sequence:  Enzymatic Nucleic Acid
ccgcuucagccgaaaggcgagugaggucuauuuguac

SEQ ID NO: 20403 - RNA, 37 nt, Artificial Sequence
  Description of Artificial Sequence:  Enzymatic Nucleic Acid
guugaccggccgaaaggcgagugaggucuuucacauu

SEQ ID NO: 20404 - RNA, 37 nt, Artificial Sequence
  Description of Artificial Sequence:  Enzymatic Nucleic Acid
uuuguugagccgaaaggcgagugaggucucgcuucac

SEQ ID NO: 20405 - RNA, 37 nt, Artificial Sequence
  Description of Artificial Sequence:  Enzymatic Nucleic Acid
ucucccgagccgaaaggcgagugaggucuuuuguuga

SEQ ID NO: 20406 - RNA, 37 nt, Artificial Sequence
  Description of Artificial Sequence:  Enzymatic Nucleic Acid
ggagaucagccgaaaggcgagugaggucuccucucuc

SEQ ID NO: 20407 - RNA, 37 nt, Artificial Sequence
  Description of Artificial Sequence:  Enzymatic Nucleic Acid
ccuggucagccgaaaggcgagugaggucuguggaagg

SEQ ID NO: 20408 - RNA, 37 nt, Artificial Sequence
  Description of Artificial Sequence:  Enzymatic Nucleic Acid
uuucaggagccgaaaggcgagugaggucucccugguc

SEQ ID NO: 20409 - RNA, 37 nt, Artificial Sequence
  Description of Artificial Sequence:  Enzymatic Nucleic Acid
ucagguuggccgaaaggcgagugaggucuaaaguaau

SEQ ID NO: 20410 - RNA, 37 nt, Artificial Sequence
  Description of Artificial Sequence:  Enzymatic Nucleic Acid
gugggcuggccgaaaggcgagugaggucuaugucagg

SEQ ID NO: 20411 - RNA, 37 nt, Artificial Sequence
  Description of Artificial Sequence:  Enzymatic Nucleic Acid
ucaguggggccgaaaggcgagugaggucuugcauguc

SEQ ID NO: 20412 - RNA, 37 nt, Artificial Sequence
  Description of Artificial Sequence:  Enzymatic Nucleic Acid
cucuccuggccgaaaggcgagugaggucuucaguggg

SEQ ID NO: 20413 - RNA, 37 nt, Artificial Sequence
  Description of Artificial Sequence:  Enzymatic Nucleic Acid
aagacacggccgaaaggcgagugaggucuucuccugc

SEQ ID NO: 20414 - RNA, 37 nt, Artificial Sequence
  Description of Artificial Sequence:  Enzymatic Nucleic Acid
caaagacagccgaaaggcgagugaggucugcucuccu

SEQ ID NO: 20415 - RNA, 37 nt, Artificial Sequence
  Description of Artificial Sequence:  Enzymatic Nucleic Acid
cacaaagagccgaaaggcgagugaggucuacgcucuc

SEQ ID NO: 20416 - RNA, 37 nt, Artificial Sequence
  Description of Artificial Sequence:  Enzymatic Nucleic Acid
gugcaccagccgaaaggcgagugaggucuaaagacac

SEQ ID NO: 20417 - RNA, 37 nt, Artificial Sequence
  Description of Artificial Sequence:  Enzymatic Nucleic Acid
gcagugcagccgaaaggcgagugaggucucacaaaga

SEQ ID NO: 20418 - RNA, 37 nt, Artificial Sequence
  Description of Artificial Sequence:  Enzymatic Nucleic Acid
cugcaguggccgaaaggcgagugaggucuaccacaaa

SEQ ID NO: 20419 - RNA, 37 nt, Artificial Sequence
  Description of Artificial Sequence:  Enzymatic Nucleic Acid
ucugucuggccgaaaggcgagugaggucuagugcacc

SEQ ID NO: 20420 - RNA, 37 nt, Artificial Sequence
  Description of Artificial Sequence:  Enzymatic Nucleic Acid
uucucaaagccgaaaggcgagugaggucuguagaucu

SEQ ID NO: 20421 - RNA, 37 nt, Artificial Sequence
  Description of Artificial Sequence:  Enzymatic Nucleic Acid
agcuuguagccgaaaggcgagugaggucucaugugag

SEQ ID NO: 20422 - RNA, 37 nt, Artificial Sequence
  Description of Artificial Sequence:  Enzymatic Nucleic Acid
gggccaaggccgaaaggcgagugaggucuuuguacca

SEQ ID NO: 20423 - RNA, 37 nt, Artificial Sequence
  Description of Artificial Sequence:  Enzymatic Nucleic Acid
gcuguggggccgaaaggcgagugaggucucaagcuug

SEQ ID NO: 20424 - RNA, 37 nt, Artificial Sequence
  Description of Artificial Sequence:  Enzymatic Nucleic Acid
ggcagagggccgaaaggcgagugaggucuugugggcc

SEQ ID NO: 20425 - RNA, 37 nt, Artificial Sequence
  Description of Artificial Sequence:  Enzymatic Nucleic Acid
uggauugggccgaaaggcgagugaggucuagaggcug

SEQ ID NO: 20426 - RNA, 37 nt, Artificial Sequence
  Description of Artificial Sequence:  Enzymatic Nucleic Acid
cucucccagccgaaaggcgagugaggucuauggauug

SEQ ID NO: 20427 - RNA, 37 nt, Artificial Sequence
  Description of Artificial Sequence:  Enzymatic Nucleic Acid
gugggcaagccgaaaggcgagugaggucuucucccac

SEQ ID NO: 20428 - RNA, 37 nt, Artificial Sequence
  Description of Artificial Sequence:  Enzymatic Nucleic Acid
gguguggggccgaaaggcgagugaggucuaacucucc

SEQ ID NO: 20429 - RNA, 37 nt, Artificial Sequence
  Description of Artificial Sequence:  Enzymatic Nucleic Acid
cuugcaaagccgaaaggcgagugaggucuaggugugg

SEQ ID NO: 20430 - RNA, 37 nt, Artificial Sequence
  Description of Artificial Sequence:  Enzymatic Nucleic Acid
aguucuuggccgaaaggcgagugaggucuaaacaggu

SEQ ID NO: 20431 - RNA, 37 nt, Artificial Sequence
  Description of Artificial Sequence:  Enzymatic Nucleic Acid
cauggugggccgaaaggcgagugaggucuauucaauu

SEQ ID NO: 20432 - RNA, 37 nt, Artificial Sequence
  Description of Artificial Sequence:  Enzymatic Nucleic Acid
uuagagaagccgaaaggcgagugaggucuaugguggc

SEQ ID NO: 20433 - RNA, 37 nt, Artificial Sequence
  Description of Artificial Sequence:  Enzymatic Nucleic Acid
cauuuguggccgaaaggcgagugaggucuuauuagag

SEQ ID NO: 20434 - RNA, 37 nt, Artificial Sequence
  Description of Artificial Sequence:  Enzymatic Nucleic Acid
uucuuaaggccgaaaggcgagugaggucuuccaugau

SEQ ID NO: 20435 - RNA, 37 nt, Artificial Sequence
  Description of Artificial Sequence:  Enzymatic Nucleic Acid
caaggauggccgaaaggcgagugaggucuauucuuaa

SEQ ID NO: 20436 - RNA, 37 nt, Artificial Sequence
  Description of Artificial Sequence:  Enzymatic Nucleic Acid
ugguccuggccgaaaggcgagugaggucuaaggaugc

SEQ ID NO: 20437 - RNA, 37 nt, Artificial Sequence
  Description of Artificial Sequence:  Enzymatic Nucleic Acid
aaggcagagccgaaaggcgagugaggucuauagucuc

SEQ ID NO: 20438 - RNA, 37 nt, Artificial Sequence
  Description of Artificial Sequence:  Enzymatic Nucleic Acid
gagcaagggccgaaaggcgagugaggucuagacauag

SEQ ID NO: 20439 - RNA, 37 nt, Artificial Sequence
  Description of Artificial Sequence:  Enzymatic Nucleic Acid
gucuugaggccgaaaggcgagugaggucuaaggcaga

SEQ ID NO: 20440 - RNA, 37 nt, Artificial Sequence
  Description of Artificial Sequence:  Enzymatic Nucleic Acid
ugaccacggccgaaaggcgagugaggucuaaugucuu

SEQ ID NO: 20441 - RNA, 37 nt, Artificial Sequence
  Description of Artificial Sequence:  Enzymatic Nucleic Acid
ccugaccagccgaaaggcgagugaggucugcaauguc

SEQ ID NO: 20442 - RNA, 37 nt, Artificial Sequence
  Description of Artificial Sequence:  Enzymatic Nucleic Acid
cugccugagccgaaaggcgagugaggucucacgcaau

SEQ ID NO: 20443 - RNA, 37 nt, Artificial Sequence
  Description of Artificial Sequence:  Enzymatic Nucleic Acid
gugagcuggccgaaaggcgagugaggucucugaccac

SEQ ID NO: 20444 - RNA, 37 nt, Artificial Sequence
  Description of Artificial Sequence:  Enzymatic Nucleic Acid
acugugaggccgaaaggcgagugaggucuugccugac

SEQ ID NO: 20445 - RNA, 37 nt, Artificial Sequence
  Description of Artificial Sequence:  Enzymatic Nucleic Acid
cucuaggagccgaaaggcgagugaggucuugugagcu

SEQ ID NO: 20446 - RNA, 37 nt, Artificial Sequence
  Description of Artificial Sequence:  Enzymatic Nucleic Acid
gccacacggccgaaaggcgagugaggucuucuaggac

SEQ ID NO: 20447 - RNA, 37 nt, Artificial Sequence
  Description of Artificial Sequence:  Enzymatic Nucleic Acid
gugccacagccgaaaggcgagugaggucugcucuagg

SEQ ID NO: 20448 - RNA, 37 nt, Artificial Sequence
  Description of Artificial Sequence:  Enzymatic Nucleic Acid
gggugccagccgaaaggcgagugaggucuacgcucua

SEQ ID NO: 20449 - RNA, 37 nt, Artificial Sequence
  Description of Artificial Sequence:  Enzymatic Nucleic Acid
cguggguggccgaaaggcgagugaggucucacacgcu

SEQ ID NO: 20450 - RNA, 37 nt, Artificial Sequence
  Description of Artificial Sequence:  Enzymatic Nucleic Acid
ccccaauagccgaaaggcgagugaggucuuugucguc

SEQ ID NO: 20451 - RNA, 37 nt, Artificial Sequence
  Description of Artificial Sequence:  Enzymatic Nucleic Acid
cuucgauggccgaaaggcgagugaggucuuuucccca

SEQ ID NO: 20452 - RNA, 37 nt, Artificial Sequence
  Description of Artificial Sequence:  Enzymatic Nucleic Acid
gcaugagagccgaaaggcgagugaggucuuucgaugc

SEQ ID NO: 20453 - RNA, 37 nt, Artificial Sequence
  Description of Artificial Sequence:  Enzymatic Nucleic Acid
augccguggccgaaaggcgagugaggucuaugagacu

SEQ ID NO: 20454 - RNA, 37 nt, Artificial Sequence
  Description of Artificial Sequence:  Enzymatic Nucleic Acid
cccagauggccgaaaggcgagugaggucucgugcaug

SEQ ID NO: 20455 - RNA, 37 nt, Artificial Sequence
  Description of Artificial Sequence:  Enzymatic Nucleic Acid
uuaaaccagccgaaaggcgagugaggucuaugaucug

SEQ ID NO: 20456 - RNA, 37 nt, Artificial Sequence
  Description of Artificial Sequence:  Enzymatic Nucleic Acid
ucuuuaaagccgaaaggcgagugaggucucacaugau

SEQ ID NO: 20457 - RNA, 37 nt, Artificial Sequence
  Description of Artificial Sequence:  Enzymatic Nucleic Acid
gucuucuagccgaaaggcgagugaggucuaagggucu

SEQ ID NO: 20458 - RNA, 37 nt, Artificial Sequence
  Description of Artificial Sequence:  Enzymatic Nucleic Acid
auacaauggccgaaaggcgagugaggucucugagucu

SEQ ID NO: 20459 - RNA, 37 nt, Artificial Sequence
  Description of Artificial Sequence:  Enzymatic Nucleic Acid
cuucaauagccgaaaggcgagugaggucuaaugccug

SEQ ID NO: 20460 - RNA, 37 nt, Artificial Sequence
  Description of Artificial Sequence:  Enzymatic Nucleic Acid
ucacucuggccgaaaggcgagugaggucuggauagug

SEQ ID NO: 20461 - RNA, 37 nt, Artificial Sequence
  Description of Artificial Sequence:  Enzymatic Nucleic Acid
cuuccucagccgaaaggcgagugaggucuucugcgga

SEQ ID NO: 20462 - RNA, 37 nt, Artificial Sequence
  Description of Artificial Sequence:  Enzymatic Nucleic Acid
uguagagggccgaaaggcgagugaggucucuucgucc

SEQ ID NO: 20463 - RNA, 37 nt, Artificial Sequence
  Description of Artificial Sequence:  Enzymatic Nucleic Acid
augccugggccgaaaggcgagugaggucuagguguag

SEQ ID NO: 20464 - RNA, 37 nt, Artificial Sequence
  Description of Artificial Sequence:  Enzymatic Nucleic Acid
acugcauggccgaaaggcgagugaggucucuggcagg

SEQ ID NO: 20465 - RNA, 37 nt, Artificial Sequence
  Description of Artificial Sequence:  Enzymatic Nucleic Acid
gaacacuggccgaaaggcgagugaggucuaugccugg

SEQ ID NO: 20466 - RNA, 37 nt, Artificial Sequence
  Description of Artificial Sequence:  Enzymatic Nucleic Acid
caagaacagccgaaaggcgagugaggucuugcaugcc

SEQ ID NO: 20467 - RNA, 37 nt, Artificial Sequence
  Description of Artificial Sequence:  Enzymatic Nucleic Acid
gccaagaagccgaaaggcgagugaggucuacugcaug

SEQ ID NO: 20468 - RNA, 37 nt, Artificial Sequence
  Description of Artificial Sequence:  Enzymatic Nucleic Acid
uugcacaggccgaaaggcgagugaggucucaagaaca

SEQ ID NO: 20469 - RNA, 37 nt, Artificial Sequence
  Description of Artificial Sequence:  Enzymatic Nucleic Acid
cuuuugcagccgaaaggcgagugaggucuagccaaga

SEQ ID NO: 20470 - RNA, 37 nt, Artificial Sequence
  Description of Artificial Sequence:  Enzymatic Nucleic Acid
cacuuuuggccgaaaggcgagugaggucuacagccaa

SEQ ID NO: 20471 - RNA, 37 nt, Artificial Sequence
  Description of Artificial Sequence:  Enzymatic Nucleic Acid
ugccuccagccgaaaggcgagugaggucuuuuugcac

SEQ ID NO: 20472 - RNA, 37 nt, Artificial Sequence
  Description of Artificial Sequence:  Enzymatic Nucleic Acid
gaaaaauggccgaaaggcgagugaggucucuccacuu

SEQ ID NO: 20473 - RNA, 37 nt, Artificial Sequence
  Description of Artificial Sequence:  Enzymatic Nucleic Acid
ccugggcagccgaaaggcgagugaggucucuucuauu

SEQ ID NO: 20474 - RNA, 37 nt, Artificial Sequence
  Description of Artificial Sequence:  Enzymatic Nucleic Acid
uuccuggggccgaaaggcgagugaggucuaccuucua

SEQ ID NO: 20475 - RNA, 37 nt, Artificial Sequence
  Description of Artificial Sequence:  Enzymatic Nucleic Acid
cgugccuagccgaaaggcgagugaggucuuagaauaa

SEQ ID NO: 20476 - RNA, 37 nt, Artificial Sequence
  Description of Artificial Sequence:  Enzymatic Nucleic Acid
ccgccguggccgaaaggcgagugaggucucuacuaga

SEQ ID NO: 20477 - RNA, 37 nt, Artificial Sequence
  Description of Artificial Sequence:  Enzymatic Nucleic Acid
aaucaccggccgaaaggcgagugaggucucgugccua

SEQ ID NO: 20478 - RNA, 37 nt, Artificial Sequence
  Description of Artificial Sequence:  Enzymatic Nucleic Acid
ggcaaucagccgaaaggcgagugaggucucgccgugc

SEQ ID NO: 20479 - RNA, 37 nt, Artificial Sequence
  Description of Artificial Sequence:  Enzymatic Nucleic Acid
gaacaugggccgaaaggcgagugaggucuaaucaccg

SEQ ID NO: 20480 - RNA, 37 nt, Artificial Sequence
  Description of Artificial Sequence:  Enzymatic Nucleic Acid
cagaagaagccgaaaggcgagugaggucuauggcaau

SEQ ID NO: 20481 - RNA, 37 nt, Artificial Sequence
  Description of Artificial Sequence:  Enzymatic Nucleic Acid
agaaguaggccgaaaggcgagugaggucucagaagaa

SEQ ID NO: 20482 - RNA, 37 nt, Artificial Sequence
  Description of Artificial Sequence:  Enzymatic Nucleic Acid
gaugaugagccgaaaggcgagugaggucuaagaagua

SEQ ID NO: 20483 - RNA, 37 nt, Artificial Sequence
  Description of Artificial Sequence:  Enzymatic Nucleic Acid
ccgcuuaagccgaaaggcgagugaggucugguccgua

SEQ ID NO: 20484 - RNA, 37 nt, Artificial Sequence
  Description of Artificial Sequence:  Enzymatic Nucleic Acid
uuggcccggccgaaaggcgagugaggucuuuaacggu

SEQ ID NO: 20485 - RNA, 37 nt, Artificial Sequence
  Description of Artificial Sequence:  Enzymatic Nucleic Acid
uccauugggccgaaaggcgagugaggucuccgcuuaa

SEQ ID NO: 20486 - RNA, 37 nt, Artificial Sequence
  Description of Artificial Sequence:  Enzymatic Nucleic Acid
acaaguaggccgaaaggcgagugaggucucugucuuc

SEQ ID NO: 20487 - RNA, 37 nt, Artificial Sequence
  Description of Artificial Sequence:  Enzymatic Nucleic Acid
acgauggagccgaaaggcgagugaggucuaaguagcc

SEQ ID NO: 20488 - RNA, 37 nt, Artificial Sequence
  Description of Artificial Sequence:  Enzymatic Nucleic Acid
auccaugagccgaaaggcgagugaggucugauggaca

SEQ ID NO: 20489 - RNA, 37 nt, Artificial Sequence
  Description of Artificial Sequence:  Enzymatic Nucleic Acid
gucguucagccgaaaggcgagugaggucuaauguuca

SEQ ID NO: 20490 - RNA, 37 nt, Artificial Sequence
  Description of Artificial Sequence:  Enzymatic Nucleic Acid
ucauaagggccgaaaggcgagugaggucuagucguuc

SEQ ID NO: 20491 - RNA, 37 nt, Artificial Sequence
  Description of Artificial Sequence:  Enzymatic Nucleic Acid
uuugcugggccgaaaggcgagugaggucuaucauaag

SEQ ID NO: 20492 - RNA, 37 nt, Artificial Sequence
  Description of Artificial Sequence:  Enzymatic Nucleic Acid
cccauuuggccgaaaggcgagugaggucuuggcauca

SEQ ID NO: 20493 - RNA, 37 nt, Artificial Sequence
  Description of Artificial Sequence:  Enzymatic Nucleic Acid
agcuucaggccgaaaggcgagugaggucucggucucu

SEQ ID NO: 20494 - RNA, 37 nt, Artificial Sequence
  Description of Artificial Sequence:  Enzymatic Nucleic Acid
uuaccuaggccgaaaggcgagugaggucuuucagccg

SEQ ID NO: 20495 - RNA, 37 nt, Artificial Sequence
  Description of Artificial Sequence:  Enzymatic Nucleic Acid
gaggcuuagccgaaaggcgagugaggucucuagcuuc

SEQ ID NO: 20496 - RNA, 37 nt, Artificial Sequence
  Description of Artificial Sequence:  Enzymatic Nucleic Acid
ccaagagggccgaaaggcgagugaggucuuuaccuag

SEQ ID NO: 20497 - RNA, 37 nt, Artificial Sequence
  Description of Artificial Sequence:  Enzymatic Nucleic Acid
caccacgggccgaaaggcgagugaggucucaagaggc

SEQ ID NO: 20498 - RNA, 37 nt, Artificial Sequence
  Description of Artificial Sequence:  Enzymatic Nucleic Acid
aggcaccagccgaaaggcgagugaggucuggccaaga

SEQ ID NO: 20499 - RNA, 37 nt, Artificial Sequence
  Description of Artificial Sequence:  Enzymatic Nucleic Acid
caaaggcagccgaaaggcgagugaggucucacggcca

SEQ ID NO: 20500 - RNA, 37 nt, Artificial Sequence
  Description of Artificial Sequence:  Enzymatic Nucleic Acid
gccaaagggccgaaaggcgagugaggucuaccacggc

SEQ ID NO: 20501 - RNA, 37 nt, Artificial Sequence
  Description of Artificial Sequence:  Enzymatic Nucleic Acid
ucacuugggccgaaaggcgagugaggucucaaaggca

SEQ ID NO: 20502 - RNA, 37 nt, Artificial Sequence
  Description of Artificial Sequence:  Enzymatic Nucleic Acid
uucaaucagccgaaaggcgagugaggucuuuggccaa

SEQ ID NO: 20503 - RNA, 37 nt, Artificial Sequence
  Description of Artificial Sequence:  Enzymatic Nucleic Acid
ggcaucuggccgaaaggcgagugaggucuuucaauca

SEQ ID NO: 20504 - RNA, 37 nt, Artificial Sequence
  Description of Artificial Sequence:  Enzymatic Nucleic Acid
uccaaagggccgaaaggcgagugaggucuaucugcuu

SEQ ID NO: 20505 - RNA, 37 nt, Artificial Sequence
  Description of Artificial Sequence:  Enzymatic Nucleic Acid
gcaaguuggccgaaaggcgagugaggucuugucuugu

SEQ ID NO: 20506 - RNA, 37 nt, Artificial Sequence
  Description of Artificial Sequence:  Enzymatic Nucleic Acid
cuguccuggccgaaaggcgagugaggucuaaguugcu

SEQ ID NO: 20507 - RNA, 37 nt, Artificial Sequence
  Description of Artificial Sequence:  Enzymatic Nucleic Acid
gacugcuagccgaaaggcgagugaggucuuguccugc

SEQ ID NO: 20508 - RNA, 37 nt, Artificial Sequence
  Description of Artificial Sequence:  Enzymatic Nucleic Acid
uuugacuggccgaaaggcgagugaggucuuacugucc

SEQ ID NO: 20509 - RNA, 37 nt, Artificial Sequence
  Description of Artificial Sequence:  Enzymatic Nucleic Acid
cauuuugagccgaaaggcgagugaggucuugcuacug

SEQ ID NO: 20510 - RNA, 37 nt, Artificial Sequence
  Description of Artificial Sequence:  Enzymatic Nucleic Acid
ucuuucaagccgaaaggcgagugaggucuauuuugac

SEQ ID NO: 20511 - RNA, 37 nt, Artificial Sequence
  Description of Artificial Sequence:  Enzymatic Nucleic Acid
guguguuggccgaaaggcgagugaggucuuccuucuu

SEQ ID NO: 20512 - RNA, 37 nt, Artificial Sequence
  Description of Artificial Sequence:  Enzymatic Nucleic Acid
gaugcucagccgaaaggcgagugaggucuuguguguu

SEQ ID NO: 20513 - RNA, 37 nt, Artificial Sequence
  Description of Artificial Sequence:  Enzymatic Nucleic Acid
gcucgauggccgaaaggcgagugaggucuucacugug

SEQ ID NO: 20514 - RNA, 37 nt, Artificial Sequence
  Description of Artificial Sequence:  Enzymatic Nucleic Acid
caugagaggccgaaaggcgagugaggucuucgaugcu

SEQ ID NO: 20515 - RNA, 37 nt, Artificial Sequence
  Description of Artificial Sequence:  Enzymatic Nucleic Acid
aguucagagccgaaaggcgagugaggucuaugagagc

SEQ ID NO: 20516 - RNA, 37 nt, Artificial Sequence
  Description of Artificial Sequence:  Enzymatic Nucleic Acid
gauggugagccgaaaggcgagugaggucucaauauga

SEQ ID NO: 20517 - RNA, 37 nt, Artificial Sequence
  Description of Artificial Sequence:  Enzymatic Nucleic Acid
guugaccagccgaaaggcgagugaggucuauugagau

SEQ ID NO: 20518 - RNA, 37 nt, Artificial Sequence
  Description of Artificial Sequence:  Enzymatic Nucleic Acid
aagguugagccgaaaggcgagugaggucucacauuga

SEQ ID NO: 20519 - RNA, 37 nt, Artificial Sequence
  Description of Artificial Sequence:  Enzymatic Nucleic Acid
uacaggcagccgaaaggcgagugaggucucuagaagg

SEQ ID NO: 20520 - RNA, 37 nt, Artificial Sequence
  Description of Artificial Sequence:  Enzymatic Nucleic Acid
gguacagggccgaaaggcgagugaggucuaccuagaa

SEQ ID NO: 20521 - RNA, 37 nt, Artificial Sequence
  Description of Artificial Sequence:  Enzymatic Nucleic Acid
gcuugguagccgaaaggcgagugaggucuaggcaccu

SEQ ID NO: 20522 - RNA, 37 nt, Artificial Sequence
  Description of Artificial Sequence:  Enzymatic Nucleic Acid
ccuccugggccgaaaggcgagugaggucuuugguaca

SEQ ID NO: 20523 - RNA, 37 nt, Artificial Sequence
  Description of Artificial Sequence:  Enzymatic Nucleic Acid
augagugggccgaaaggcgagugaggucuccuccugg

SEQ ID NO: 20524 - RNA, 37 nt, Artificial Sequence
  Description of Artificial Sequence:  Enzymatic Nucleic Acid
cacaaucagccgaaaggcgagugaggucucaugagug

SEQ ID NO: 20525 - RNA, 37 nt, Artificial Sequence
  Description of Artificial Sequence:  Enzymatic Nucleic Acid
gaauuccagccgaaaggcgagugaggucuaaucacca

SEQ ID NO: 20526 - RNA, 37 nt, Artificial Sequence
  Description of Artificial Sequence:  Enzymatic Nucleic Acid
caaauuuggccgaaaggcgagugaggucuagaauucc

SEQ ID NO: 20527 - RNA, 37 nt, Artificial Sequence
  Description of Artificial Sequence:  Enzymatic Nucleic Acid
uaaguggagccgaaaggcgagugaggucuagguuucc

SEQ ID NO: 20528 - RNA, 37 nt, Artificial Sequence
  Description of Artificial Sequence:  Enzymatic Nucleic Acid
uucucuuggccgaaaggcgagugaggucuuccucagg

SEQ ID NO: 20529 - RNA, 37 nt, Artificial Sequence
  Description of Artificial Sequence:  Enzymatic Nucleic Acid
guaggggagccgaaaggcgagugaggucuaaauucau

SEQ ID NO: 20530 - RNA, 37 nt, Artificial Sequence
  Description of Artificial Sequence:  Enzymatic Nucleic Acid
gaaucguggccgaaaggcgagugaggucucccuuugg

SEQ ID NO: 20531 - RNA, 37 nt, Artificial Sequence
  Description of Artificial Sequence:  Enzymatic Nucleic Acid
ucccuugagccgaaaggcgagugaggucuggaaucgu

SEQ ID NO: 20532 - RNA, 37 nt, Artificial Sequence
  Description of Artificial Sequence:  Enzymatic Nucleic Acid
ugcuccaagccgaaaggcgagugaggucuguagucuu

SEQ ID NO: 20533 - RNA, 37 nt, Artificial Sequence
  Description of Artificial Sequence:  Enzymatic Nucleic Acid
agggauuggccgaaaggcgagugaggucuuccaacgu

SEQ ID NO: 20534 - RNA, 37 nt, Artificial Sequence
  Description of Artificial Sequence:  Enzymatic Nucleic Acid
cagauccagccgaaaggcgagugaggucuagggauug

SEQ ID NO: 20535 - RNA, 37 nt, Artificial Sequence
  Description of Artificial Sequence:  Enzymatic Nucleic Acid
uccaagcggccgaaaggcgagugaggucucguuucag

SEQ ID NO: 20536 - RNA, 37 nt, Artificial Sequence
  Description of Artificial Sequence:  Enzymatic Nucleic Acid
uguccaaggccgaaaggcgagugaggucugccguuuc

SEQ ID NO: 20537 - RNA, 37 nt, Artificial Sequence
  Description of Artificial Sequence:  Enzymatic Nucleic Acid
uggugauggccgaaaggcgagugaggucuuguccaag

SEQ ID NO: 20538 - RNA, 37 nt, Artificial Sequence
  Description of Artificial Sequence:  Enzymatic Nucleic Acid
ucuggcuagccgaaaggcgagugaggucuuggugaug

SEQ ID NO: 20539 - RNA, 37 nt, Artificial Sequence
  Description of Artificial Sequence:  Enzymatic Nucleic Acid
agcucugggccgaaaggcgagugaggucuuacuggug

SEQ ID NO: 20540 - RNA, 37 nt, Artificial Sequence
  Description of Artificial Sequence:  Enzymatic Nucleic Acid
uggcugaggccgaaaggcgagugaggucuucuggcua

SEQ ID NO: 20541 - RNA, 37 nt, Artificial Sequence
  Description of Artificial Sequence:  Enzymatic Nucleic Acid
agagcugggccgaaaggcgagugaggucuugagcucu

SEQ ID NO: 20542 - RNA, 37 nt, Artificial Sequence
  Description of Artificial Sequence:  Enzymatic Nucleic Acid
auccagaggccgaaaggcgagugaggucuuggcugag

SEQ ID NO: 20543 - RNA, 37 nt, Artificial Sequence
  Description of Artificial Sequence:  Enzymatic Nucleic Acid
cuccuccagccgaaaggcgagugaggucuaaauccag

SEQ ID NO: 20544 - RNA, 37 nt, Artificial Sequence
  Description of Artificial Sequence:  Enzymatic Nucleic Acid
cugagggagccgaaaggcgagugaggucuuucuccuc

SEQ ID NO: 20545 - RNA, 37 nt, Artificial Sequence
  Description of Artificial Sequence:  Enzymatic Nucleic Acid
cuacaucagccgaaaggcgagugaggucuugagggac

SEQ ID NO: 20546 - RNA, 37 nt, Artificial Sequence
  Description of Artificial Sequence:  Enzymatic Nucleic Acid
uucuucuagccgaaaggcgagugaggucuaucacuga

SEQ ID NO: 20547 - RNA, 37 nt, Artificial Sequence
  Description of Artificial Sequence:  Enzymatic Nucleic Acid
uucaggaggccgaaaggcgagugaggucuuuccucuu

SEQ ID NO: 20548 - RNA, 37 nt, Artificial Sequence
  Description of Artificial Sequence:  Enzymatic Nucleic Acid
uccuuauagccgaaaggcgagugaggucuagaucuuc

SEQ ID NO: 20549 - RNA, 37 nt, Artificial Sequence
  Description of Artificial Sequence:  Enzymatic Nucleic Acid
augagauggccgaaaggcgagugaggucuuccaaggu

SEQ ID NO: 20550 - RNA, 37 nt, Artificial Sequence
  Description of Artificial Sequence:  Enzymatic Nucleic Acid
agcuguaagccgaaaggcgagugaggucuagaugaga

SEQ ID NO: 20551 - RNA, 37 nt, Artificial Sequence
  Description of Artificial Sequence:  Enzymatic Nucleic Acid
cuuggaaggccgaaaggcgagugaggucuuguaacag

SEQ ID NO: 20552 - RNA, 37 nt, Artificial Sequence
  Description of Artificial Sequence:  Enzymatic Nucleic Acid
cuuagccagccgaaaggcgagugaggucuuuggaagc

SEQ ID NO: 20553 - RNA, 37 nt, Artificial Sequence
  Description of Artificial Sequence:  Enzymatic Nucleic Acid
gcccuuaggccgaaaggcgagugaggucucacuugga

SEQ ID NO: 20554 - RNA, 37 nt, Artificial Sequence
  Description of Artificial Sequence:  Enzymatic Nucleic Acid
acuccauggccgaaaggcgagugaggucuccuuagcc

SEQ ID NO: 20555 - RNA, 37 nt, Artificial Sequence
  Description of Artificial Sequence:  Enzymatic Nucleic Acid
gccaagaagccgaaaggcgagugaggucuuccaugcc

SEQ ID NO: 20556 - RNA, 37 nt, Artificial Sequence
  Description of Artificial Sequence:  Enzymatic Nucleic Acid
ucgcgauggccgaaaggcgagugaggucucaagaacu

SEQ ID NO: 20557 - RNA, 37 nt, Artificial Sequence
  Description of Artificial Sequence:  Enzymatic Nucleic Acid
cacuuucggccgaaaggcgagugaggucugaugccaa

SEQ ID NO: 20558 - RNA, 37 nt, Artificial Sequence
  Description of Artificial Sequence:  Enzymatic Nucleic Acid
uggauacagccgaaaggcgagugaggucuuuucgcga

SEQ ID NO: 20559 - RNA, 37 nt, Artificial Sequence
  Description of Artificial Sequence:  Enzymatic Nucleic Acid
uguggauagccgaaaggcgagugaggucuacuuucgc

SEQ ID NO: 20560 - RNA, 37 nt, Artificial Sequence
  Description of Artificial Sequence:  Enzymatic Nucleic Acid
ucgugccggccgaaaggcgagugaggucucagguccc

SEQ ID NO: 20561 - RNA, 37 nt, Artificial Sequence
  Description of Artificial Sequence:  Enzymatic Nucleic Acid
auuucguggccgaaaggcgagugaggucucgccaggu

SEQ ID NO: 20562 - RNA, 37 nt, Artificial Sequence
  Description of Artificial Sequence:  Enzymatic Nucleic Acid
uuuaaccagccgaaaggcgagugaggucuguucuucu

SEQ ID NO: 20563 - RNA, 37 nt, Artificial Sequence
  Description of Artificial Sequence:  Enzymatic Nucleic Acid
gauuuuaagccgaaaggcgagugaggucucacguucu

SEQ ID NO: 20564 - RNA, 37 nt, Artificial Sequence
  Description of Artificial Sequence:  Enzymatic Nucleic Acid
caaagucagccgaaaggcgagugaggucuagauuuua

SEQ ID NO: 20565 - RNA, 37 nt, Artificial Sequence
  Description of Artificial Sequence:  Enzymatic Nucleic Acid
gggccaaggccgaaaggcgagugaggucucaaaguca

SEQ ID NO: 20566 - RNA, 37 nt, Artificial Sequence
  Description of Artificial Sequence:  Enzymatic Nucleic Acid
aucccggggccgaaaggcgagugaggucucaagccaa

SEQ ID NO: 20567 - RNA, 37 nt, Artificial Sequence
  Description of Artificial Sequence:  Enzymatic Nucleic Acid
uuuucugagccgaaaggcgagugaggucuauaaucug

SEQ ID NO: 20568 - RNA, 37 nt, Artificial Sequence
  Description of Artificial Sequence:  Enzymatic Nucleic Acid
gaggcgaggccgaaaggcgagugaggucuaucuccuu

SEQ ID NO: 20569 - RNA, 37 nt, Artificial Sequence
  Description of Artificial Sequence:  Enzymatic Nucleic Acid
aagggagggccgaaaggcgagugaggucugagcaucu

SEQ ID NO: 20570 - RNA, 37 nt, Artificial Sequence
  Description of Artificial Sequence:  Enzymatic Nucleic Acid
uucugggggccgaaaggcgagugaggucucauccauu

SEQ ID NO: 20571 - RNA, 37 nt, Artificial Sequence
  Description of Artificial Sequence:  Enzymatic Nucleic Acid
uguguacagccgaaaggcgagugaggucuucugucaa

SEQ ID NO: 20572 - RNA, 37 nt, Artificial Sequence
  Description of Artificial Sequence:  Enzymatic Nucleic Acid
auuguguagccgaaaggcgagugaggucuacucuguc

SEQ ID NO: 20573 - RNA, 37 nt, Artificial Sequence
  Description of Artificial Sequence:  Enzymatic Nucleic Acid
agacgucagccgaaaggcgagugaggucuucuggauu

SEQ ID NO: 20574 - RNA, 37 nt, Artificial Sequence
  Description of Artificial Sequence:  Enzymatic Nucleic Acid
agaccagagccgaaaggcgagugaggucugucacucu

SEQ ID NO: 20575 - RNA, 37 nt, Artificial Sequence
  Description of Artificial Sequence:  Enzymatic Nucleic Acid
ccaaaagagccgaaaggcgagugaggucucagacguc

SEQ ID NO: 20576 - RNA, 37 nt, Artificial Sequence
  Description of Artificial Sequence:  Enzymatic Nucleic Acid
gcaaaacagccgaaaggcgagugaggucucaaaagac

SEQ ID NO: 20577 - RNA, 37 nt, Artificial Sequence
  Description of Artificial Sequence:  Enzymatic Nucleic Acid
cagcaaaagccgaaaggcgagugaggucuaccaaaag

SEQ ID NO: 20578 - RNA, 37 nt, Artificial Sequence
  Description of Artificial Sequence:  Enzymatic Nucleic Acid
ucccacaggccgaaaggcgagugaggucuaaaacacc

SEQ ID NO: 20579 - RNA, 37 nt, Artificial Sequence
  Description of Artificial Sequence:  Enzymatic Nucleic Acid
auuucccagccgaaaggcgagugaggucuagcaaaac

SEQ ID NO: 20580 - RNA, 37 nt, Artificial Sequence
  Description of Artificial Sequence:  Enzymatic Nucleic Acid
gagaagcagccgaaaggcgagugaggucucuaaggaa

SEQ ID NO: 20581 - RNA, 37 nt, Artificial Sequence
  Description of Artificial Sequence:  Enzymatic Nucleic Acid
uggagaaggccgaaaggcgagugaggucuaccuaagg

SEQ ID NO: 20582 - RNA, 37 nt, Artificial Sequence
  Description of Artificial Sequence:  Enzymatic Nucleic Acid
aaucuuuagccgaaaggcgagugaggucucccaggau

SEQ ID NO: 20583 - RNA, 37 nt, Artificial Sequence
  Description of Artificial Sequence:  Enzymatic Nucleic Acid
aucgccuagccgaaaggcgagugaggucuaaaauucu

SEQ ID NO: 20584 - RNA, 37 nt, Artificial Sequence
  Description of Artificial Sequence:  Enzymatic Nucleic Acid
uucaaucggccgaaaggcgagugaggucucuacaaaa

SEQ ID NO: 20585 - RNA, 37 nt, Artificial Sequence
  Description of Artificial Sequence:  Enzymatic Nucleic Acid
aucagggggccgaaaggcgagugaggucuccucauuc

SEQ ID NO: 20586 - RNA, 37 nt, Artificial Sequence
  Description of Artificial Sequence:  Enzymatic Nucleic Acid
gucugguagccgaaaggcgagugaggucuauuucugg

SEQ ID NO: 20587 - RNA, 37 nt, Artificial Sequence
  Description of Artificial Sequence:  Enzymatic Nucleic Acid
caguccaggccgaaaggcgagugaggucuauggucug

SEQ ID NO: 20588 - RNA, 37 nt, Artificial Sequence
  Description of Artificial Sequence:  Enzymatic Nucleic Acid
cgugccaggccgaaaggcgagugaggucuaguccagc

SEQ ID NO: 20589 - RNA, 37 nt, Artificial Sequence
  Description of Artificial Sequence:  Enzymatic Nucleic Acid
uccccguggccgaaaggcgagugaggucucagcaguc

SEQ ID NO: 20590 - RNA, 37 nt, Artificial Sequence
  Description of Artificial Sequence:  Enzymatic Nucleic Acid
ugacuggggccgaaaggcgagugaggucuuccccgug

SEQ ID NO: 20591 - RNA, 37 nt, Artificial Sequence
  Description of Artificial Sequence:  Enzymatic Nucleic Acid
gucucugagccgaaaggcgagugaggucuugggcucc

SEQ ID NO: 20592 - RNA, 37 nt, Artificial Sequence
  Description of Artificial Sequence:  Enzymatic Nucleic Acid
ucugaaaagccgaaaggcgagugaggucugugggucu

SEQ ID NO: 20593 - RNA, 37 nt, Artificial Sequence
  Description of Artificial Sequence:  Enzymatic Nucleic Acid
uccaccaagccgaaaggcgagugaggucuucugaaaa

SEQ ID NO: 20594 - RNA, 37 nt, Artificial Sequence
  Description of Artificial Sequence:  Enzymatic Nucleic Acid
auguuccagccgaaaggcgagugaggucucaacucug

SEQ ID NO: 20595 - RNA, 37 nt, Artificial Sequence
  Description of Artificial Sequence:  Enzymatic Nucleic Acid
uuagcuuggccgaaaggcgagugaggucuaagagauu

SEQ ID NO: 20596 - RNA, 37 nt, Artificial Sequence
  Description of Artificial Sequence:  Enzymatic Nucleic Acid
agcauuaggccgaaaggcgagugaggucuuugcaaga

SEQ ID NO: 20597 - RNA, 37 nt, Artificial Sequence
  Description of Artificial Sequence:  Enzymatic Nucleic Acid
cugcugaggccgaaaggcgagugaggucuauuagcuu

SEQ ID NO: 20598 - RNA, 37 nt, Artificial Sequence
  Description of Artificial Sequence:  Enzymatic Nucleic Acid
ccauccuggccgaaaggcgagugaggucuugagcauu

SEQ ID NO: 20599 - RNA, 37 nt, Artificial Sequence
  Description of Artificial Sequence:  Enzymatic Nucleic Acid
agucuuuggccgaaaggcgagugaggucucauccugc

SEQ ID NO: 20600 - RNA, 37 nt, Artificial Sequence
  Description of Artificial Sequence:  Enzymatic Nucleic Acid
cggaagaagccgaaaggcgagugaggucuaauguagu

SEQ ID NO: 20601 - RNA, 37 nt, Artificial Sequence
  Description of Artificial Sequence:  Enzymatic Nucleic Acid
cuuccauggccgaaaggcgagugaggucuucaaaguc

SEQ ID NO: 20602 - RNA, 37 nt, Artificial Sequence
  Description of Artificial Sequence:  Enzymatic Nucleic Acid
gagguagggccgaaaggcgagugaggucuagagagag

SEQ ID NO: 20603 - RNA, 37 nt, Artificial Sequence
  Description of Artificial Sequence:  Enzymatic Nucleic Acid
acaggaaagccgaaaggcgagugaggucuaggugagg

SEQ ID NO: 20604 - RNA, 37 nt, Artificial Sequence
  Description of Artificial Sequence:  Enzymatic Nucleic Acid
ccuccauagccgaaaggcgagugaggucuaggaaaca

SEQ ID NO: 20605 - RNA, 37 nt, Artificial Sequence
  Description of Artificial Sequence:  Enzymatic Nucleic Acid
gucacauagccgaaaggcgagugaggucuuuccuccu

SEQ ID NO: 20606 - RNA, 37 nt, Artificial Sequence
  Description of Artificial Sequence:  Enzymatic Nucleic Acid
uggggucagccgaaaggcgagugaggucuauacuucc

SEQ ID NO: 20607 - RNA, 37 nt, Artificial Sequence
  Description of Artificial Sequence:  Enzymatic Nucleic Acid
gauuccuggccgaaaggcgagugaggucuuguguugu

SEQ ID NO: 20608 - RNA, 37 nt, Artificial Sequence
  Description of Artificial Sequence:  Enzymatic Nucleic Acid
gauacugagccgaaaggcgagugaggucuugauuccu

SEQ ID NO: 20609 - RNA, 37 nt, Artificial Sequence
  Description of Artificial Sequence:  Enzymatic Nucleic Acid
ugcagauagccgaaaggcgagugaggucuugacugau

SEQ ID NO: 20610 - RNA, 37 nt, Artificial Sequence
  Description of Artificial Sequence:  Enzymatic Nucleic Acid
cuguucuggccgaaaggcgagugaggucuagauacug

SEQ ID NO: 20611 - RNA, 37 nt, Artificial Sequence
  Description of Artificial Sequence:  Enzymatic Nucleic Acid
uucgcuuagccgaaaggcgagugaggucuuguucugc

SEQ ID NO: 20612 - RNA, 37 nt, Artificial Sequence
  Description of Artificial Sequence:  Enzymatic Nucleic Acid
cucuuucggccgaaaggcgagugaggucuuuacuguu

SEQ ID NO: 20613 - RNA, 37 nt, Artificial Sequence
  Description of Artificial Sequence:  Enzymatic Nucleic Acid
caggccgggccgaaaggcgagugaggucuucuuucgc

SEQ ID NO: 20614 - RNA, 37 nt, Artificial Sequence
  Description of Artificial Sequence:  Enzymatic Nucleic Acid
cucacagggccgaaaggcgagugaggucucggcucuu

SEQ ID NO: 20615 - RNA, 37 nt, Artificial Sequence
  Description of Artificial Sequence:  Enzymatic Nucleic Acid
uacacucagccgaaaggcgagugaggucuaggccggc

SEQ ID NO: 20616 - RNA, 37 nt, Artificial Sequence
  Description of Artificial Sequence:  Enzymatic Nucleic Acid
uuuuuacagccgaaaggcgagugaggucuucacaggc

SEQ ID NO: 20617 - RNA, 37 nt, Artificial Sequence
  Description of Artificial Sequence:  Enzymatic Nucleic Acid
uguuuuuagccgaaaggcgagugaggucuacucacag

SEQ ID NO: 20618 - RNA, 37 nt, Artificial Sequence
  Description of Artificial Sequence:  Enzymatic Nucleic Acid
ucuucuaagccgaaaggcgagugaggucugggauauc

SEQ ID NO: 20619 - RNA, 37 nt, Artificial Sequence
  Description of Artificial Sequence:  Enzymatic Nucleic Acid
uacuuuuagccgaaaggcgagugaggucuuucugguu

SEQ ID NO: 20620 - RNA, 37 nt, Artificial Sequence
  Description of Artificial Sequence:  Enzymatic Nucleic Acid
ugggauuagccgaaaggcgagugaggucuuuuuacuu

SEQ ID NO: 20621 - RNA, 37 nt, Artificial Sequence
  Description of Artificial Sequence:  Enzymatic Nucleic Acid
ccauaccagccgaaaggcgagugaggucuuguccguc

SEQ ID NO: 20622 - RNA, 37 nt, Artificial Sequence
  Description of Artificial Sequence:  Enzymatic Nucleic Acid
gaaccauagccgaaaggcgagugaggucucacugucc

SEQ ID NO: 20623 - RNA, 37 nt, Artificial Sequence
  Description of Artificial Sequence:  Enzymatic Nucleic Acid
ggcaagaagccgaaaggcgagugaggucucauaccac

SEQ ID NO: 20624 - RNA, 37 nt, Artificial Sequence
  Description of Artificial Sequence:  Enzymatic Nucleic Acid
uucugagggccgaaaggcgagugaggucuaagaacca

SEQ ID NO: 20625 - RNA, 37 nt, Artificial Sequence
  Description of Artificial Sequence:  Enzymatic Nucleic Acid
guuuucaggccgaaaggcgagugaggucuucuucuga

SEQ ID NO: 20626 - RNA, 37 nt, Artificial Sequence
  Description of Artificial Sequence:  Enzymatic Nucleic Acid
ccauuccagccgaaaggcgagugaggucucaaaagau

SEQ ID NO: 20627 - RNA, 37 nt, Artificial Sequence
  Description of Artificial Sequence:  Enzymatic Nucleic Acid
gcugggcagccgaaaggcgagugaggucucauuccac

SEQ ID NO: 20628 - RNA, 37 nt, Artificial Sequence
  Description of Artificial Sequence:  Enzymatic Nucleic Acid
uugcuggggccgaaaggcgagugaggucuaccauucc

SEQ ID NO: 20629 - RNA, 37 nt, Artificial Sequence
  Description of Artificial Sequence:  Enzymatic Nucleic Acid
ugcuuuuggccgaaaggcgagugaggucuugggcacc

SEQ ID NO: 20630 - RNA, 37 nt, Artificial Sequence
  Description of Artificial Sequence:  Enzymatic Nucleic Acid
acucccuggccgaaaggcgagugaggucuuuuugcug

SEQ ID NO: 20631 - RNA, 37 nt, Artificial Sequence
  Description of Artificial Sequence:  Enzymatic Nucleic Acid
gccacagagccgaaaggcgagugaggucuucccugcu

SEQ ID NO: 20632 - RNA, 37 nt, Artificial Sequence
  Description of Artificial Sequence:  Enzymatic Nucleic Acid
agaugccagccgaaaggcgagugaggucuagacuccc

SEQ ID NO: 20633 - RNA, 37 nt, Artificial Sequence
  Description of Artificial Sequence:  Enzymatic Nucleic Acid
uucagauggccgaaaggcgagugaggucucacagacu

SEQ ID NO: 20634 - RNA, 37 nt, Artificial Sequence
  Description of Artificial Sequence:  Enzymatic Nucleic Acid
gguuugaggccgaaaggcgagugaggucucuucagau

SEQ ID NO: 20635 - RNA, 37 nt, Artificial Sequence
  Description of Artificial Sequence:  Enzymatic Nucleic Acid
gguagccggccgaaaggcgagugaggucuuugucugg

SEQ ID NO: 20636 - RNA, 37 nt, Artificial Sequence
  Description of Artificial Sequence:  Enzymatic Nucleic Acid
acugguaggccgaaaggcgagugaggucucgcuuguc

SEQ ID NO: 20637 - RNA, 37 nt, Artificial Sequence
  Description of Artificial Sequence:  Enzymatic Nucleic Acid
uauccggagccgaaaggcgagugaggucuugguagcc

SEQ ID NO: 20638 - RNA, 37 nt, Artificial Sequence
  Description of Artificial Sequence:  Enzymatic Nucleic Acid
ggaguacagccgaaaggcgagugaggucugguggugu

SEQ ID NO: 20639 - RNA, 37 nt, Artificial Sequence
  Description of Artificial Sequence:  Enzymatic Nucleic Acid
cuggaguagccgaaaggcgagugaggucuacgguggu

SEQ ID NO: 20640 - RNA, 37 nt, Artificial Sequence
  Description of Artificial Sequence:  Enzymatic Nucleic Acid
cuuccucagccgaaaggcgagugaggucuuggaguac

SEQ ID NO: 20641 - RNA, 37 nt, Artificial Sequence
  Description of Artificial Sequence:  Enzymatic Nucleic Acid
aaguucuggccgaaaggcgagugaggucuuuccucac

SEQ ID NO: 20642 - RNA, 37 nt, Artificial Sequence
  Description of Artificial Sequence:  Enzymatic Nucleic Acid
ucuaucaggccgaaaggcgagugaggucuuuuaaaag

SEQ ID NO: 20643 - RNA, 37 nt, Artificial Sequence
  Description of Artificial Sequence:  Enzymatic Nucleic Acid
gguuugcagccgaaaggcgagugaggucuuccaaucu

SEQ ID NO: 20644 - RNA, 37 nt, Artificial Sequence
  Description of Artificial Sequence:  Enzymatic Nucleic Acid
ccgguuuggccgaaaggcgagugaggucuacuccaau

SEQ ID NO: 20645 - RNA, 37 nt, Artificial Sequence
  Description of Artificial Sequence:  Enzymatic Nucleic Acid
cugugcuagccgaaaggcgagugaggucucgguuugc

SEQ ID NO: 20646 - RNA, 37 nt, Artificial Sequence
  Description of Artificial Sequence:  Enzymatic Nucleic Acid
gggcuguggccgaaaggcgagugaggucuuaccgguu

SEQ ID NO: 20647 - RNA, 37 nt, Artificial Sequence
  Description of Artificial Sequence:  Enzymatic Nucleic Acid
aaucuggggccgaaaggcgagugaggucuugugcuac

SEQ ID NO: 20648 - RNA, 37 nt, Artificial Sequence
  Description of Artificial Sequence:  Enzymatic Nucleic Acid
gagucagggccgaaaggcgagugaggucuuggagaau

SEQ ID NO: 20649 - RNA, 37 nt, Artificial Sequence
  Description of Artificial Sequence:  Enzymatic Nucleic Acid
gaggagaggccgaaaggcgagugaggucuucagugug

SEQ ID NO: 20650 - RNA, 37 nt, Artificial Sequence
  Description of Artificial Sequence:  Enzymatic Nucleic Acid
cuuuuaaagccgaaaggcgagugaggucuaggaggag

SEQ ID NO: 20651 - RNA, 37 nt, Artificial Sequence
  Description of Artificial Sequence:  Enzymatic Nucleic Acid
uguggauggccgaaaggcgagugaggucuuuccuuuu

SEQ ID NO: 20652 - RNA, 37 nt, Artificial Sequence
  Description of Artificial Sequence:  Enzymatic Nucleic Acid
ugagcagagccgaaaggcgagugaggucucucucaug

SEQ ID NO: 20653 - RNA, 37 nt, Artificial Sequence
  Description of Artificial Sequence:  Enzymatic Nucleic Acid
aaucugaggccgaaaggcgagugaggucuagaccucu

SEQ ID NO: 20654 - RNA, 37 nt, Artificial Sequence
  Description of Artificial Sequence:  Enzymatic Nucleic Acid
gaacaacagccgaaaggcgagugaggucuuucaaaau

SEQ ID NO: 20655 - RNA, 37 nt, Artificial Sequence
  Description of Artificial Sequence:  Enzymatic Nucleic Acid
aagaacaagccgaaaggcgagugaggucuacuucaaa

SEQ ID NO: 20656 - RNA, 37 nt, Artificial Sequence
  Description of Artificial Sequence:  Enzymatic Nucleic Acid
ggaaagaagccgaaaggcgagugaggucuaacacuuc

SEQ ID NO: 20657 - RNA, 37 nt, Artificial Sequence
  Description of Artificial Sequence:  Enzymatic Nucleic Acid
acuuccuggccgaaaggcgagugaggucuugguggaa

SEQ ID NO: 20658 - RNA, 37 nt, Artificial Sequence
  Description of Artificial Sequence:  Enzymatic Nucleic Acid
ugcggcuagccgaaaggcgagugaggucuuuccugcu

SEQ ID NO: 20659 - RNA, 37 nt, Artificial Sequence
  Description of Artificial Sequence:  Enzymatic Nucleic Acid
aaaugcgggccgaaaggcgagugaggucuuacuuccu

SEQ ID NO: 20660 - RNA, 37 nt, Artificial Sequence
  Description of Artificial Sequence:  Enzymatic Nucleic Acid
aucaaauggccgaaaggcgagugaggucuggcuacuu

SEQ ID NO: 20661 - RNA, 37 nt, Artificial Sequence
  Description of Artificial Sequence:  Enzymatic Nucleic Acid
gcucccuggccgaaaggcgagugaggucuaguccgag

SEQ ID NO: 20662 - RNA, 37 nt, Artificial Sequence
  Description of Artificial Sequence:  Enzymatic Nucleic Acid
aagacugggccgaaaggcgagugaggucuucccugca

SEQ ID NO: 20663 - RNA, 37 nt, Artificial Sequence
  Description of Artificial Sequence:  Enzymatic Nucleic Acid
cuagaagagccgaaaggcgagugaggucuuggcuccc

SEQ ID NO: 20664 - RNA, 37 nt, Artificial Sequence
  Description of Artificial Sequence:  Enzymatic Nucleic Acid
aggauauggccgaaaggcgagugaggucucuagaaga

SEQ ID NO: 20665 - RNA, 37 nt, Artificial Sequence
  Description of Artificial Sequence:  Enzymatic Nucleic Acid
gucacaaggccgaaaggcgagugaggucucucuucca

SEQ ID NO: 20666 - RNA, 37 nt, Artificial Sequence
  Description of Artificial Sequence:  Enzymatic Nucleic Acid
uugggucagccgaaaggcgagugaggucuaagccucu

SEQ ID NO: 20667 - RNA, 37 nt, Artificial Sequence
  Description of Artificial Sequence:  Enzymatic Nucleic Acid
cacagacagccgaaaggcgagugaggucuauucuugg

SEQ ID NO: 20668 - RNA, 37 nt, Artificial Sequence
  Description of Artificial Sequence:  Enzymatic Nucleic Acid
gacacagagccgaaaggcgagugaggucuacauucuu

SEQ ID NO: 20669 - RNA, 37 nt, Artificial Sequence
  Description of Artificial Sequence:  Enzymatic Nucleic Acid
agaagacagccgaaaggcgagugaggucuagacacau

SEQ ID NO: 20670 - RNA, 37 nt, Artificial Sequence
  Description of Artificial Sequence:  Enzymatic Nucleic Acid
ggagaagagccgaaaggcgagugaggucuacagacac

SEQ ID NO: 20671 - RNA, 37 nt, Artificial Sequence
  Description of Artificial Sequence:  Enzymatic Nucleic Acid
ggucaacagccgaaaggcgagugaggucuugggagaa

SEQ ID NO: 20672 - RNA, 37 nt, Artificial Sequence
  Description of Artificial Sequence:  Enzymatic Nucleic Acid
caggucaagccgaaaggcgagugaggucuacugggag

SEQ ID NO: 20673 - RNA, 37 nt, Artificial Sequence
  Description of Artificial Sequence:  Enzymatic Nucleic Acid
ugauaauggccgaaaggcgagugaggucuuuuuuaaa

SEQ ID NO: 20674 - RNA, 37 nt, Artificial Sequence
  Description of Artificial Sequence:  Enzymatic Nucleic Acid
agcagggggccgaaaggcgagugaggucuaugauaau

SEQ ID NO: 20675 - RNA, 37 nt, Artificial Sequence
  Description of Artificial Sequence:  Enzymatic Nucleic Acid
acccgcaggccgaaaggcgagugaggucuaggggcau

SEQ ID NO: 20676 - RNA, 37 nt, Artificial Sequence
  Description of Artificial Sequence:  Enzymatic Nucleic Acid
gagacccggccgaaaggcgagugaggucuagcagggg

SEQ ID NO: 20677 - RNA, 37 nt, Artificial Sequence
  Description of Artificial Sequence:  Enzymatic Nucleic Acid
uggugagagccgaaaggcgagugaggucuccgcagca

SEQ ID NO: 20678 - RNA, 37 nt, Artificial Sequence
  Description of Artificial Sequence:  Enzymatic Nucleic Acid
guucuaaagccgaaaggcgagugaggucuccauggug

SEQ ID NO: 20679 - RNA, 37 nt, Artificial Sequence
  Description of Artificial Sequence:  Enzymatic Nucleic Acid
gcuugaaggccgaaaggcgagugaggucuucuuuguu

SEQ ID NO: 20680 - RNA, 37 nt, Artificial Sequence
  Description of Artificial Sequence:  Enzymatic Nucleic Acid
ggccauuggccgaaaggcgagugaggucuuugaagcu

SEQ ID NO: 20681 - RNA, 37 nt, Artificial Sequence
  Description of Artificial Sequence:  Enzymatic Nucleic Acid
ggaugggggccgaaaggcgagugaggucucauugcuu

SEQ ID NO: 20682 - RNA, 37 nt, Artificial Sequence
  Description of Artificial Sequence:  Enzymatic Nucleic Acid
uacugcuagccgaaaggcgagugaggucuuucuuuga

SEQ ID NO: 20683 - RNA, 37 nt, Artificial Sequence
  Description of Artificial Sequence:  Enzymatic Nucleic Acid
agguacuggccgaaaggcgagugaggucuuacuucuu

SEQ ID NO: 20684 - RNA, 37 nt, Artificial Sequence
  Description of Artificial Sequence:  Enzymatic Nucleic Acid
cccagguagccgaaaggcgagugaggucuugcuacuu

SEQ ID NO: 20685 - RNA, 37 nt, Artificial Sequence
  Description of Artificial Sequence:  Enzymatic Nucleic Acid
agugucaggccgaaaggcgagugaggucuuccccagg

SEQ ID NO: 20686 - RNA, 37 nt, Artificial Sequence
  Description of Artificial Sequence:  Enzymatic Nucleic Acid
uaguuuuagccgaaaggcgagugaggucuagaagugu

SEQ ID NO: 20687 - RNA, 37 nt, Artificial Sequence
  Description of Artificial Sequence:  Enzymatic Nucleic Acid
uuacguuggccgaaaggcgagugaggucucugguuua

SEQ ID NO: 20688 - RNA, 37 nt, Artificial Sequence
  Description of Artificial Sequence:  Enzymatic Nucleic Acid
aacacuuagccgaaaggcgagugaggucuguugccug

SEQ ID NO: 20689 - RNA, 37 nt, Artificial Sequence
  Description of Artificial Sequence:  Enzymatic Nucleic Acid
cucgaacagccgaaaggcgagugaggucuuuacguug

SEQ ID NO: 20690 - RNA, 37 nt, Artificial Sequence
  Description of Artificial Sequence:  Enzymatic Nucleic Acid
accucgaagccgaaaggcgagugaggucuacuuacgu

SEQ ID NO: 20691 - RNA, 37 nt, Artificial Sequence
  Description of Artificial Sequence:  Enzymatic Nucleic Acid
cuucaacagccgaaaggcgagugaggucucucgaaca

SEQ ID NO: 20692 - RNA, 37 nt, Artificial Sequence
  Description of Artificial Sequence:  Enzymatic Nucleic Acid
aucuucaagccgaaaggcgagugaggucuaccucgaa

SEQ ID NO: 20693 - RNA, 37 nt, Artificial Sequence
  Description of Artificial Sequence:  Enzymatic Nucleic Acid
cagcccuggccgaaaggcgagugaggucuaaauccuu

SEQ ID NO: 20694 - RNA, 37 nt, Artificial Sequence
  Description of Artificial Sequence:  Enzymatic Nucleic Acid
agacucaggccgaaaggcgagugaggucuccugcaaa

SEQ ID NO: 20695 - RNA, 37 nt, Artificial Sequence
  Description of Artificial Sequence:  Enzymatic Nucleic Acid
uggauagagccgaaaggcgagugaggucuucagcccu

SEQ ID NO: 20696 - RNA, 37 nt, Artificial Sequence
  Description of Artificial Sequence:  Enzymatic Nucleic Acid
aaacaaaggccgaaaggcgagugaggucucucuugga

SEQ ID NO: 20697 - RNA, 37 nt, Artificial Sequence
  Description of Artificial Sequence:  Enzymatic Nucleic Acid
guccuaaagccgaaaggcgagugaggucuaaagccuc

SEQ ID NO: 20698 - RNA, 37 nt, Artificial Sequence
  Description of Artificial Sequence:  Enzymatic Nucleic Acid
gggacccagccgaaaggcgagugaggucuguccuaaa

SEQ ID NO: 20699 - RNA, 37 nt, Artificial Sequence
  Description of Artificial Sequence:  Enzymatic Nucleic Acid
gcuugggagccgaaaggcgagugaggucuccacgucc

SEQ ID NO: 20700 - RNA, 37 nt, Artificial Sequence
  Description of Artificial Sequence:  Enzymatic Nucleic Acid
aggcuugggccgaaaggcgagugaggucuuugggacc

SEQ ID NO: 20701 - RNA, 37 nt, Artificial Sequence
  Description of Artificial Sequence:  Enzymatic Nucleic Acid
acuuaagggccgaaaggcgagugaggucuuuggcuug

SEQ ID NO: 20702 - RNA, 37 nt, Artificial Sequence
  Description of Artificial Sequence:  Enzymatic Nucleic Acid
auuccacagccgaaaggcgagugaggucuuuaaggcu

SEQ ID NO: 20703 - RNA, 37 nt, Artificial Sequence
  Description of Artificial Sequence:  Enzymatic Nucleic Acid
gaauuccagccgaaaggcgagugaggucuacuuaagg

SEQ ID NO: 20704 - RNA, 37 nt, Artificial Sequence
  Description of Artificial Sequence:  Enzymatic Nucleic Acid
caagguaagccgaaaggcgagugaggucuguuagucu

SEQ ID NO: 20705 - RNA, 37 nt, Artificial Sequence
  Description of Artificial Sequence:  Enzymatic Nucleic Acid
cuccaaaggccgaaaggcgagugaggucuaagguaac

SEQ ID NO: 20706 - RNA, 37 nt, Artificial Sequence
  Description of Artificial Sequence:  Enzymatic Nucleic Acid
cuccaguagccgaaaggcgagugaggucuucuccaaa

SEQ ID NO: 20707 - RNA, 37 nt, Artificial Sequence
  Description of Artificial Sequence:  Enzymatic Nucleic Acid
uuugcagggccgaaaggcgagugaggucuuccaguac

SEQ ID NO: 20708 - RNA, 37 nt, Artificial Sequence
  Description of Artificial Sequence:  Enzymatic Nucleic Acid
ugcauuuggccgaaaggcgagugaggucuaggcucca

SEQ ID NO: 20709 - RNA, 37 nt, Artificial Sequence
  Description of Artificial Sequence:  Enzymatic Nucleic Acid
acacaauggccgaaaggcgagugaggucuauuugcag

SEQ ID NO: 20710 - RNA, 37 nt, Artificial Sequence
  Description of Artificial Sequence:  Enzymatic Nucleic Acid
agcaaacagccgaaaggcgagugaggucuaaugcauu

SEQ ID NO: 20711 - RNA, 37 nt, Artificial Sequence
  Description of Artificial Sequence:  Enzymatic Nucleic Acid
agagcaaagccgaaaggcgagugaggucuacaaugca

SEQ ID NO: 20712 - RNA, 37 nt, Artificial Sequence
  Description of Artificial Sequence:  Enzymatic Nucleic Acid
caccagaggccgaaaggcgagugaggucuaaacacaa

SEQ ID NO: 20713 - RNA, 37 nt, Artificial Sequence
  Description of Artificial Sequence:  Enzymatic Nucleic Acid
caccuccagccgaaaggcgagugaggucucagagcaa

SEQ ID NO: 20714 - RNA, 37 nt, Artificial Sequence
  Description of Artificial Sequence:  Enzymatic Nucleic Acid
caugcccagccgaaaggcgagugaggucucuccacca

SEQ ID NO: 20715 - RNA, 37 nt, Artificial Sequence
  Description of Artificial Sequence:  Enzymatic Nucleic Acid
accccauggccgaaaggcgagugaggucuccaccucc

SEQ ID NO: 20716 - RNA, 37 nt, Artificial Sequence
  Description of Artificial Sequence:  Enzymatic Nucleic Acid
agaacagagccgaaaggcgagugaggucucccaugcc

SEQ ID NO: 20717 - RNA, 37 nt, Artificial Sequence
  Description of Artificial Sequence:  Enzymatic Nucleic Acid
uuucagaagccgaaaggcgagugaggucuagacccca

SEQ ID NO: 20718 - RNA, 37 nt, Artificial Sequence
  Description of Artificial Sequence:  Enzymatic Nucleic Acid
acccuuuagccgaaaggcgagugaggucuauuucaga

SEQ ID NO: 20719 - RNA, 37 nt, Artificial Sequence
  Description of Artificial Sequence:  Enzymatic Nucleic Acid
cgucugaagccgaaaggcgagugaggucuccuuuaca

SEQ ID NO: 20720 - RNA, 37 nt, Artificial Sequence
  Description of Artificial Sequence:  Enzymatic Nucleic Acid
accagaaagccgaaaggcgagugaggucucccgucug

SEQ ID NO: 20721 - RNA, 37 nt, Artificial Sequence
  Description of Artificial Sequence:  Enzymatic Nucleic Acid
uucuaaaagccgaaaggcgagugaggucucagaaacc

SEQ ID NO: 20722 - RNA, 37 nt, Artificial Sequence
  Description of Artificial Sequence:  Enzymatic Nucleic Acid
acacgcaagccgaaaggcgagugaggucucuucuaaa

SEQ ID NO: 20723 - RNA, 37 nt, Artificial Sequence
  Description of Artificial Sequence:  Enzymatic Nucleic Acid
agaacacggccgaaaggcgagugaggucuaaccuucu

SEQ ID NO: 20724 - RNA, 37 nt, Artificial Sequence
  Description of Artificial Sequence:  Enzymatic Nucleic Acid
gaagaacagccgaaaggcgagugaggucugcaaccuu

SEQ ID NO: 20725 - RNA, 37 nt, Artificial Sequence
  Description of Artificial Sequence:  Enzymatic Nucleic Acid
ucgaagaagccgaaaggcgagugaggucuacgcaacc

SEQ ID NO: 20726 - RNA, 37 nt, Artificial Sequence
  Description of Artificial Sequence:  Enzymatic Nucleic Acid
uagcccaagccgaaaggcgagugaggucuucgaagaa

SEQ ID NO: 20727 - RNA, 37 nt, Artificial Sequence
  Description of Artificial Sequence:  Enzymatic Nucleic Acid
uacuuuaggccgaaaggcgagugaggucuccaacucg

SEQ ID NO: 20728 - RNA, 37 nt, Artificial Sequence
  Description of Artificial Sequence:  Enzymatic Nucleic Acid
gaacucuagccgaaaggcgagugaggucuuuuagccc

SEQ ID NO: 20729 - RNA, 37 nt, Artificial Sequence
  Description of Artificial Sequence:  Enzymatic Nucleic Acid
acaacgaagccgaaaggcgagugaggucuucuacuuu

SEQ ID NO: 20730 - RNA, 37 nt, Artificial Sequence
  Description of Artificial Sequence:  Enzymatic Nucleic Acid
cagcacaagccgaaaggcgagugaggucugaacucua

SEQ ID NO: 20731 - RNA, 37 nt, Artificial Sequence
  Description of Artificial Sequence:  Enzymatic Nucleic Acid
aaacagcagccgaaaggcgagugaggucuaacgaacu

SEQ ID NO: 20732 - RNA, 37 nt, Artificial Sequence
  Description of Artificial Sequence:  Enzymatic Nucleic Acid
agaaacaggccgaaaggcgagugaggucuacaacgaa

SEQ ID NO: 20733 - RNA, 37 nt, Artificial Sequence
  Description of Artificial Sequence:  Enzymatic Nucleic Acid
gucagaaagccgaaaggcgagugaggucuagcacaac

SEQ ID NO: 20734 - RNA, 37 nt, Artificial Sequence
  Description of Artificial Sequence:  Enzymatic Nucleic Acid
ggaaggaagccgaaaggcgagugaggucuucucauua

SEQ ID NO: 20735 - RNA, 37 nt, Artificial Sequence
  Description of Artificial Sequence:  Enzymatic Nucleic Acid
acagcuaagccgaaaggcgagugaggucuggucugga

SEQ ID NO: 20736 - RNA, 37 nt, Artificial Sequence
  Description of Artificial Sequence:  Enzymatic Nucleic Acid
ggagacaggccgaaaggcgagugaggucuuaacgguc

SEQ ID NO: 20737 - RNA, 37 nt, Artificial Sequence
  Description of Artificial Sequence:  Enzymatic Nucleic Acid
caaggagagccgaaaggcgagugaggucuagcuaacg

SEQ ID NO: 20738 - RNA, 37 nt, Artificial Sequence
  Description of Artificial Sequence:  Enzymatic Nucleic Acid
gggcuugggccgaaaggcgagugaggucuaaggagac

SEQ ID NO: 20739 - RNA, 37 nt, Artificial Sequence
  Description of Artificial Sequence:  Enzymatic Nucleic Acid
uccugggggccgaaaggcgagugaggucuuuggcaag

SEQ ID NO: 20740 - RNA, 37 nt, Artificial Sequence
  Description of Artificial Sequence:  Enzymatic Nucleic Acid
cagagcuggccgaaaggcgagugaggucuaucauuuu

SEQ ID NO: 20741 - RNA, 37 nt, Artificial Sequence
  Description of Artificial Sequence:  Enzymatic Nucleic Acid
agccagaggccgaaaggcgagugaggucuugcaucau

SEQ ID NO: 20742 - RNA, 37 nt, Artificial Sequence
  Description of Artificial Sequence:  Enzymatic Nucleic Acid
acaaggaggccgaaaggcgagugaggucucagagcug

SEQ ID NO: 20743 - RNA, 37 nt, Artificial Sequence
  Description of Artificial Sequence:  Enzymatic Nucleic Acid
cugggagagccgaaaggcgagugaggucuaaggagcc

SEQ ID NO: 20744 - RNA, 37 nt, Artificial Sequence
  Description of Artificial Sequence:  Enzymatic Nucleic Acid
aggaucaggccgaaaggcgagugaggucucugggaga

SEQ ID NO: 20745 - RNA, 37 nt, Artificial Sequence
  Description of Artificial Sequence:  Enzymatic Nucleic Acid
gccuugaggccgaaaggcgagugaggucuugaauguc

SEQ ID NO: 20746 - RNA, 37 nt, Artificial Sequence
  Description of Artificial Sequence:  Enzymatic Nucleic Acid
gcagggaggccgaaaggcgagugaggucucuugagcu

SEQ ID NO: 20747 - RNA, 37 nt, Artificial Sequence
  Description of Artificial Sequence:  Enzymatic Nucleic Acid
caacacgggccgaaaggcgagugaggucuagggagcc

SEQ ID NO: 20748 - RNA, 37 nt, Artificial Sequence
  Description of Artificial Sequence:  Enzymatic Nucleic Acid
cuucaacagccgaaaggcgagugaggucuggcaggga

SEQ ID NO: 20749 - RNA, 37 nt, Artificial Sequence
  Description of Artificial Sequence:  Enzymatic Nucleic Acid
cucuucaagccgaaaggcgagugaggucuacggcagg

SEQ ID NO: 20750 - RNA, 37 nt, Artificial Sequence
  Description of Artificial Sequence:  Enzymatic Nucleic Acid
agucagaagccgaaaggcgagugaggucuucuucaac

SEQ ID NO: 20751 - RNA, 37 nt, Artificial Sequence
  Description of Artificial Sequence:  Enzymatic Nucleic Acid
gguuuguggccgaaaggcgagugaggucuagucagaa

SEQ ID NO: 20752 - RNA, 37 nt, Artificial Sequence
  Description of Artificial Sequence:  Enzymatic Nucleic Acid
accagaaggccgaaaggcgagugaggucuugguuugu

SEQ ID NO: 20753 - RNA, 37 nt, Artificial Sequence
  Description of Artificial Sequence:  Enzymatic Nucleic Acid
agaagaaagccgaaaggcgagugaggucucagaagcu

SEQ ID NO: 20754 - RNA, 37 nt, Artificial Sequence
  Description of Artificial Sequence:  Enzymatic Nucleic Acid
caucaggagccgaaaggcgagugaggucuagauauga

SEQ ID NO: 20755 - RNA, 37 nt, Artificial Sequence
  Description of Artificial Sequence:  Enzymatic Nucleic Acid
acauaucagccgaaaggcgagugaggucuaucaggac

SEQ ID NO: 20756 - RNA, 37 nt, Artificial Sequence
  Description of Artificial Sequence:  Enzymatic Nucleic Acid
gucucagagccgaaaggcgagugaggucuauaucaca

SEQ ID NO: 20757 - RNA, 37 nt, Artificial Sequence
  Description of Artificial Sequence:  Enzymatic Nucleic Acid
accucccggccgaaaggcgagugaggucuauucaguc

SEQ ID NO: 20758 - RNA, 37 nt, Artificial Sequence
  Description of Artificial Sequence:  Enzymatic Nucleic Acid
acauugaagccgaaaggcgagugaggucucucccgca

SEQ ID NO: 20759 - RNA, 37 nt, Artificial Sequence
  Description of Artificial Sequence:  Enzymatic Nucleic Acid
cagcuucagccgaaaggcgagugaggucuauugaacc

SEQ ID NO: 20760 - RNA, 37 nt, Artificial Sequence
  Description of Artificial Sequence:  Enzymatic Nucleic Acid
acacacaggccgaaaggcgagugaggucuuucacauu

SEQ ID NO: 20761 - RNA, 37 nt, Artificial Sequence
  Description of Artificial Sequence:  Enzymatic Nucleic Acid
accacacagccgaaaggcgagugaggucuagcuucac

SEQ ID NO: 20762 - RNA, 37 nt, Artificial Sequence
  Description of Artificial Sequence:  Enzymatic Nucleic Acid
acaccacagccgaaaggcgagugaggucuacagcuuc

SEQ ID NO: 20763 - RNA, 37 nt, Artificial Sequence
  Description of Artificial Sequence:  Enzymatic Nucleic Acid
ugacaccagccgaaaggcgagugaggucuacacagcu

SEQ ID NO: 20764 - RNA, 37 nt, Artificial Sequence
  Description of Artificial Sequence:  Enzymatic Nucleic Acid
cuuugacagccgaaaggcgagugaggucucacacaca

SEQ ID NO: 20765 - RNA, 37 nt, Artificial Sequence
  Description of Artificial Sequence:  Enzymatic Nucleic Acid
aacuuugagccgaaaggcgagugaggucuaccacaca

SEQ ID NO: 20766 - RNA, 37 nt, Artificial Sequence
  Description of Artificial Sequence:  Enzymatic Nucleic Acid
uccugaaagccgaaaggcgagugaggucuuuugacac

SEQ ID NO: 20767 - RNA, 37 nt, Artificial Sequence
  Description of Artificial Sequence:  Enzymatic Nucleic Acid
gggaagaagccgaaaggcgagugaggucuaaaagggu

SEQ ID NO: 20768 - RNA, 37 nt, Artificial Sequence
  Description of Artificial Sequence:  Enzymatic Nucleic Acid
guuggggagccgaaaggcgagugaggucuagggggaa

SEQ ID NO: 20769 - RNA, 37 nt, Artificial Sequence
  Description of Artificial Sequence:  Enzymatic Nucleic Acid
auggguuggccgaaaggcgagugaggucuggggugag

SEQ ID NO: 20770 - RNA, 37 nt, Artificial Sequence
  Description of Artificial Sequence:  Enzymatic Nucleic Acid
cuaaaauagccgaaaggcgagugaggucuugaugggu

SEQ ID NO: 20771 - RNA, 37 nt, Artificial Sequence
  Description of Artificial Sequence:  Enzymatic Nucleic Acid
ccaaauaagccgaaaggcgagugaggucuuaaaauac

SEQ ID NO: 20772 - RNA, 37 nt, Artificial Sequence
  Description of Artificial Sequence:  Enzymatic Nucleic Acid
aguagagggccgaaaggcgagugaggucucaaauaac

SEQ ID NO: 20773 - RNA, 37 nt, Artificial Sequence
  Description of Artificial Sequence:  Enzymatic Nucleic Acid
cagguuuagccgaaaggcgagugaggucuuggaguag

SEQ ID NO: 20774 - RNA, 37 nt, Artificial Sequence
  Description of Artificial Sequence:  Enzymatic Nucleic Acid
ugaacaaagccgaaaggcgagugaggucuccaaucag

SEQ ID NO: 20775 - RNA, 37 nt, Artificial Sequence
  Description of Artificial Sequence:  Enzymatic Nucleic Acid
agagugaagccgaaaggcgagugaggucuaaacccaa

SEQ ID NO: 20776 - RNA, 37 nt, Artificial Sequence
  Description of Artificial Sequence:  Enzymatic Nucleic Acid
aagucugggccgaaaggcgagugaggucuuaauaauc

SEQ ID NO: 20777 - RNA, 37 nt, Artificial Sequence
  Description of Artificial Sequence:  Enzymatic Nucleic Acid
aauuuggggccgaaaggcgagugaggucuuauaaaau

SEQ ID NO: 20778 - RNA, 37 nt, Artificial Sequence
  Description of Artificial Sequence:  Enzymatic Nucleic Acid
aaauaauagccgaaaggcgagugaggucuaauagaug

SEQ ID NO: 20779 - RNA, 37 nt, Artificial Sequence
  Description of Artificial Sequence:  Enzymatic Nucleic Acid
agaaauaggccgaaaggcgagugaggucuucuauaug

SEQ ID NO: 20780 - RNA, 37 nt, Artificial Sequence
  Description of Artificial Sequence:  Enzymatic Nucleic Acid
aacaaggggccgaaaggcgagugaggucuaaaaauca

SEQ ID NO: 20781 - RNA, 37 nt, Artificial Sequence
  Description of Artificial Sequence:  Enzymatic Nucleic Acid
ggacagaagccgaaaggcgagugaggucuaagggcaa

SEQ ID NO: 20782 - RNA, 37 nt, Artificial Sequence
  Description of Artificial Sequence:  Enzymatic Nucleic Acid
aaaaaggagccgaaaggcgagugaggucuagaacaag

SEQ ID NO: 20783 - RNA, 37 nt, Artificial Sequence
  Description of Artificial Sequence:  Enzymatic Nucleic Acid
aaaaaacagccgaaaggcgagugaggucuauuuucuu

SEQ ID NO: 20784 - RNA, 37 nt, Artificial Sequence
  Description of Artificial Sequence:  Enzymatic Nucleic Acid
acaaaaaagccgaaaggcgagugaggucuacauuuuc

SEQ ID NO: 20785 - RNA, 37 nt, Artificial Sequence
  Description of Artificial Sequence:  Enzymatic Nucleic Acid
guaccaaagccgaaaggcgagugaggucuaaaaaaca

SEQ ID NO: 20786 - RNA, 37 nt, Artificial Sequence
  Description of Artificial Sequence:  Enzymatic Nucleic Acid
cuaugguagccgaaaggcgagugaggucucaaacaaa

SEQ ID NO: 20787 - RNA, 37 nt, Artificial Sequence
  Description of Artificial Sequence:  Enzymatic Nucleic Acid
auuucacagccgaaaggcgagugaggucuuaugguac

SEQ ID NO: 20788 - RNA, 37 nt, Artificial Sequence
  Description of Artificial Sequence:  Enzymatic Nucleic Acid
gcauuucagccgaaaggcgagugaggucuacuauggu

SEQ ID NO: 20789 - RNA, 37 nt, Artificial Sequence
  Description of Artificial Sequence:  Enzymatic Nucleic Acid
guucccaggccgaaaggcgagugaggucuauuucaca

SEQ ID NO: 20790 - RNA, 37 nt, Artificial Sequence
  Description of Artificial Sequence:  Enzymatic Nucleic Acid
ugccauaggccgaaaggcgagugaggucuaugucuua

SEQ ID NO: 20791 - RNA, 37 nt, Artificial Sequence
  Description of Artificial Sequence:  Enzymatic Nucleic Acid
uauauguggccgaaaggcgagugaggucucauagcau

SEQ ID NO: 20792 - RNA, 37 nt, Artificial Sequence
  Description of Artificial Sequence:  Enzymatic Nucleic Acid
uaaacagagccgaaaggcgagugaggucuuauaaaua

SEQ ID NO: 20793 - RNA, 37 nt, Artificial Sequence
  Description of Artificial Sequence:  Enzymatic Nucleic Acid
uacauaaagccgaaaggcgagugaggucuagacuaua

SEQ ID NO: 20794 - RNA, 37 nt, Artificial Sequence
  Description of Artificial Sequence:  Enzymatic Nucleic Acid
uguuucuagccgaaaggcgagugaggucuauaaacag

SEQ ID NO: 20795 - RNA, 37 nt, Artificial Sequence
  Description of Artificial Sequence:  Enzymatic Nucleic Acid
auauauuagccgaaaggcgagugaggucuauuuguuu

SEQ ID NO: 20796 - RNA, 37 nt, Artificial Sequence
  Description of Artificial Sequence:  Enzymatic Nucleic Acid
auauaagggccgaaaggcgagugaggucuuuuaauau

SEQ ID NO: 20797 - RNA, 37 nt, Artificial Sequence
  Description of Artificial Sequence:  Enzymatic Nucleic Acid
gaauaguagccgaaaggcgagugaggucuaaaguuca

SEQ ID NO: 20798 - RNA, 37 nt, Artificial Sequence
  Description of Artificial Sequence:  Enzymatic Nucleic Acid
uacugauagccgaaaggcgagugaggucuaaaaugug

SEQ ID NO: 20799 - RNA, 37 nt, Artificial Sequence
  Description of Artificial Sequence:  Enzymatic Nucleic Acid
acauaauagccgaaaggcgagugaggucuugauacaa

SEQ ID NO: 20800 - RNA, 37 nt, Artificial Sequence
  Description of Artificial Sequence:  Enzymatic Nucleic Acid
uuaugcuagccgaaaggcgagugaggucuauaauacu

SEQ ID NO: 20801 - RNA, 37 nt, Artificial Sequence
  Description of Artificial Sequence:  Enzymatic Nucleic Acid
uuguuauggccgaaaggcgagugaggucuuacauaau

SEQ ID NO: 20802 - RNA, 37 nt, Artificial Sequence
  Description of Artificial Sequence:  Enzymatic Nucleic Acid
cauuaugagccgaaaggcgagugaggucucuuuguua

SEQ ID NO: 20803 - RNA, 37 nt, Artificial Sequence
  Description of Artificial Sequence:  Enzymatic Nucleic Acid
gcugaaaggccgaaaggcgagugaggucuauuaugac

SEQ ID NO: 20804 - RNA, 37 nt, Artificial Sequence
  Description of Artificial Sequence:  Enzymatic Nucleic Acid
aucaauuggccgaaaggcgagugaggucuugaaagca

SEQ ID NO: 20805 - RNA, 37 nt, Artificial Sequence
  Description of Artificial Sequence:  Enzymatic Nucleic Acid
uaaaaugagccgaaaggcgagugaggucuaucaauug

SEQ ID NO: 20806 - RNA, 11 nt, Artificial Sequence
  Description of Artificial Sequence:  Miscellaneous substrate
  misc_feature (1)..(4): n stands for any a, c, g, or u
  misc_feature (7)..(11): n stands for any a, c, g, or u
nnnnuhnnnnn

SEQ ID NO: 20807 - RNA, 28 nt, Artificial Sequence
  Description of Artificial Sequence:  Enzymatic Nucleic Acid
  misc_feature (1)..(5): n stands for any a, c, g, or u
  misc_feature (13)..(18): n stands for any a, c, g, or u
  misc_feature (24)..(27): n stands for any a, c, g, or u
nnnnncugangagnnnnnncgaaannnn

SEQ ID NO: 20808 - RNA, 15 nt, Artificial Sequence
  Description of Artificial Sequence:  Miscellaneous substrate
  misc_feature (1)..(7): n stands for any a, c, g, or u
  misc_feature (9)..(9): n stands for any a, c, g, or u
  misc_feature (13)..(15): n stands for any a, c, g, or u
nnnnnnnynghynnn

SEQ ID NO: 20809 - RNA, 47 nt, Artificial Sequence
  Description of Artificial Sequence:  Enzymatic Nucleic Acid
  misc_feature (1)..(4): n stands for any a, c, g, or u
  misc_feature (9)..(19): n stands for any a, c, g, or u
  misc_feature (25)..(31): n stands for any a, c, g, or u
  misc_feature (39)..(47): n stands for any a, c, g, or u
nnnngaagnnnnnnnnnnnaaahannnnnnnacauuacnnnnnnnnn

SEQ ID NO: 20810 - RNA, 85 nt, Artificial Sequence
  Description of Artificial Sequence:  Enzymatic Nucleic Acid
uggccggcauggucccagccuccucgcuggcgccggcugggcaacauuccgaggggaccguccccucgguaauggcgaaugggac

SEQ ID NO: 20811 - RNA, 176 nt, Artificial Sequence
  Description of Artificial Sequence:  Enzymatic Nucleic Acid
gggaaagcuugcgaagggcgucgucgccccgagcgguaguaagcagggaacucaccuccaauuucaguacugaaauugucguagcaguugacuacuguuaugugauugguagaggcuaagugacgguauuggcguaagucaguauugcagcacagcacaagcccgcuugcgagaau

SEQ ID NO: 20812 - RNA, 15 nt, Artificial Sequence
  Description of Artificial Sequence:  flt-1 substrate
guaugguuaaaagau

SEQ ID NO: 20813 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(8): 2'-O-Methyl
  misc_feature (14)..(24): 2'-O-Methyl
  misc_feature (26)..(27): 2'-O-Methyl
  misc_feature (29)..(34): 2'-O-Methyl
  misc_feature (9)..(9): 2'-deoxy-2'-amino
  misc_feature (12)..(12): 2'-deoxy-2'-amino
aucuuuucugaugaggcgaaagccgaaaccauac

SEQ ID NO: 20814 - RNA, 36 nt, Artificial Sequence
  Description of Artificial Sequence:  Enzymatic Nucleic Acid
  misc_feature (2)..(5): Phosphorothioate 3'-Internucleotide Linkage
  misc_feature (1)..(8): 2'-O-Methyl
  misc_feature (14)..(26): 2'-O-Methyl
  misc_feature (28)..(29): 2'-O-Methyl
  misc_feature (31)..(36): 2'-O-Methyl
  misc_feature (9)..(9): 2'-deoxy-2'-amino
  misc_feature (12)..(12): 2'-deoxy-2'-amino
aucuuuucugaugaggccgaaaggccgaaaccauac

SEQ ID NO: 20815 - RNA, 13 nt, Artificial Sequence
  Description of Artificial Sequence:  flt-1 substrate
cagacuacaacuc

SEQ ID NO: 20816 - RNA, 32 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (13)..(23): 2'-O-Methyl
  misc_feature (25)..(26): 2'-O-Methyl
  misc_feature (28)..(32): 2'-O-Methyl
  misc_feature (8)..(8): 2'-deoxy-2'-amino
  misc_feature (11)..(11): 2'-deoxy-2'-amino
gaguggcugaugaggcgaaagccgaaagucug

SEQ ID NO: 20817 - RNA, 34 nt, Artificial Sequence
  Description of Artificial Sequence:  Enzymatic Nucleic Acid
  misc_feature (1)..(4): Phosphorothioate 3'-Internucleotide Linkage
  misc_feature (1)..(7): 2'-O-Methyl
  misc_feature (13)..(25): 2'-O-Methyl
  misc_feature (27)..(28): 2'-O-Methyl
  misc_feature (30)..(34): 2'-O-Methyl
  misc_feature (8)..(8): 2'-deoxy-2'-amino
  misc_feature (11)..(11): 2'-deoxy-2'-amino
gaguugcugaugaggccgaaaggccgaaagucug

SEQ ID NO: 20818 - RNA, 35 nt, Artificial Sequence; identical to SEQ ID NO: 13494
  Description of Artificial Sequence:  Enzymatic Nucleic Acid
  misc_feature (1)..(4): Phosphorothioate 3'-Internucleotide Linkage
  misc_feature (1)..(8): 2'-O-Methyl
  misc_feature (11)..(11): 2'-O-Methyl
  misc_feature (13)..(25): 2'-O-Methyl
  misc_feature (27)..(28): 2'-O-Methyl
  misc_feature (30)..(34): 2'-O-Methyl
  misc_feature (8)..(8): 2'-deoxy-2'-C-Allyl
  misc_feature (35)..(35): n stands for inverted deoxyabasic derivative

SEQ ID NO: 20819 - RNA, 15 nt, Homo sapiens
gcgcggcgcaggcac

SEQ ID NO: 20820 - RNA, 35 nt, Artificial Sequence
  Description of Artificial Sequence:  Enzymatic Nucleic Acid
  misc_feature (1)..(7): 2'-O-Methyl
  misc_feature (9)..(15): 2'-O-Methyl
  misc_feature (19)..(19): 2'-O-Methyl
  misc_feature (21)..(21): 2'-O-Methyl
  misc_feature (23)..(23): 2'-O-Methyl
  misc_feature (26)..(26): 2'-O-Methyl
  misc_feature (28)..(35): 2'-O-Methyl
  misc_feature (1)..(4): Phosphorothioate 3'-Internucleotide Linkage
  misc_feature (17)..(17): 2'-Deoxy-2'-Amino
  misc_feature (27)..(27): 2'-Deoxy-2'-Amino
  misc_feature (36)..(36): n stands for inverted deoxyabasic derivative
gugccuggccgaaaggcgagugaggucugccgcgc

SEQ ID NO: 20821 - DNA, 16 bp, Artificial Sequence
  Description of Artificial Sequence:  DNAzyme motif
rggctagctacaacga

SEQ ID NO: 20822 - RNA, 10 nt, Artificial Sequence
  Description of Artificial Sequence:  Enzymatic Nucleic Acid Stem Loop
gccguuaggc

SEQ ID NO: 20823 - RNA, 12 nt, Artificial Sequence
  misc_feature (1)..(12): 2'-O-Methyl
  Description of Artificial Sequence:  Enzymatic Nucleic Acid Stem II
ggccgaaaggcc

SEQ ID NO: 20824 - RNA, 37 nt, Artificial Sequence
  Description of Artificial Sequence:  Enzymatic Nucleic Acid
  misc_feature (1)..(4): Phosphorothioate 3'-Internucleotide Linkage
  misc_feature (1)..(8): 2'-O-Methyl
  misc_feature (12)..(12): 2'-O-Methyl
  misc_feature (14)..(26): 2'-O-Methyl
  misc_feature (28)..(29): 2'-O-Methyl
  misc_feature (31)..(36): 2'-O-Methyl
  misc_feature (9)..(9): 2'-deoxy-2'-amino
  misc_feature (37)..(37): n stands for 3'-3' inverted deoxythymidine
gaaggaacugaugaggccgaaaggccgaaagauggcn

SEQ ID NO: 20825 - DNA, 21 bp, Artificial Sequence
  Description of Artificial Sequence:  Antisense Nucleic Acid
gcagcaccttgctctccatcc

SEQ ID NO: 20826 - DNA, 21 bp, Artificial Sequence
  Description of Artificial Sequence:  Control Nucleic Acid
ctgccaacttcccatgcctgc

SEQ ID NO: 20827 - DNA, 22 bp, Artificial Sequence
  Description of Artificial Sequence:  Enzymatic Nucleic Acid
cugaugaggccguuaggccgaa

SEQ ID NO: 20828 - DNA, 15 bp, Artificial Sequence
  Description of Artificial Sequence:  Enzymatic Nucleic Acid
ggctagctacaacga

SEQ ID NO: 20829 - RNA, 22 nt, Artificial Sequence
  Description of Artificial Sequence:  Enzymatic Nucleic Acid
gccgaaaggcgagucaaggucu
